United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 28

SEQ ID NO: 374 - DNA, 932829 bp, Homo sapiens
tgtgccaagttcttagtatacacttcatcatattttaaagtaggacgtgtttatctgtccttaaatattaggcatcaggctcacgcctgtaatcccggcactttgggaggccgaggtgggcagatcacaaggtcaggagattgagaccatcctggctaacacagtgaaaccccgtctctactaaaaatacaaaaacttagctgggtgtggtggcgggtgcctgtagtcccagctacttggaggctgagggaggagaatggcgtgaacccaggaggcggagcttgcagtgagccgagatcgcaccactgcactccagcctgggcgacagagcaagactctatctcaaaaaataaaaaataaaaaataaatttaaaaaaataggcatcaggagggtaggagctctttttatggctccctgtgtttaacacaatgctgggcacaaaatcaggttaagattcagagggtttcgacagccaaagctattgaagggaatggcattttatacacagtatagatatccatacactggaaacacttttctggggattctgacatccatctcagcccttgctgagaactcttagctgaggggccatgaagcctgggtgctcgtgtgaaactgcaacttgcagttgactttgagggagtctcagtgcgtctccaggctccatctcctcatctgtgtaagagaagtgaagcccaatctgtcctgcctagtttcccctgggtttgttctgaggatgaaagaagatgctgtgtgtagaaccaggtcataatctggtaagtgctcaacagacgtaaggtcctgggataacatacacttgttttgataattacaacaagattcctcaggcagcctttacttctttcctagactgtgcccgctacacagtttcttcattcagcacctgcctcattctctcatgttgttttttggagacagggtcttgctctgttgcccagactagagtgcagtggcacaatcatagctcactgcagtctcaaactcctgggctccagcgatcctcctgcctcagcctcacaggtagctgggactacaggcacgaaccaccacacctctctaattttttaaaaaaatttttggtagagatggggtcttgctatgttgcccaggctggtctcaaactcatggcctcaagcaatcatccctccttggcctcctgaaaggctggaaagccactgcatctagccctattcattttctttctttccgagacagagtctctctctgttgcccaggctggagtgcagtggcacaatcttggctcactgcagcctctgcctcctggattcaagtgattcttgtgcctcagcctcctgagtagctgggatttcaggcaaccatcaccatgcccagctaatttttatattttttgtagagatggggtttagccatgttggccagactggtcttaaactcctgacctcaggtgatccacccagctcctaaagtgctgggattacaggtgtgagccaccacgcctggccccattcttttaaaaatatcagtggcttccatctattagaagtaggttgggctatacatcacactatccctaaatcttactttcatgtggtttgtttaataattaattcccaataagtctcaggggagagttctgcaatatgtataaaactttggcaagatggcatattaggaacagctctggtctgcagctcccagcgagatcgacacagaaggcgggtgatttctgcatttccgactgagggaaattgatattagggctaatatcaagaatctacaaagaacttaaacaaaattacaagaaaaaaacaaacaactccatctactgccttgagtgggcagtaggcaagctgaggcctgggtttctaagtggtcgagaggaggctggagaccagcaggggtcagacgctgagacgagacagatttaaccctcatcacaattttgctcaagtcctggggttcctgccccaccagtttccttttcggaagcctgaaaacataaaccaggtttaccaacaccctcaattcgcaaccagccccttctctccggtggatgtgtttgggaagccaggcatagagaatattgccattgacctcctcctgctcctttccttgtcccgctttattagcatcacatgaatttgatgggtgtgttgccgaagccagaataagtagtttagacggtgagggcagcagcagctcagagaagggagcagctgaaaaacctcagggcttgtgcaccacctcttgaggccagccagccttgccctgtctccaggcagctgtgctcctaaaccgcgacaaatgactaagaaatttctgctcaggggagtcctgagggaaggaaggtgctctttccctgcaggtgcatttgacgtcactcaggcacagggggcccctcccagcagcctccagaagcagcctccagagcctgggtcggtgacagcccgtctagtatttaagcatgattcagccaccctccctactcccgtgtaaatccgtggatatgcacggaatccagcttcctctttctgcacatacacacatccttttggctatttctctggaggaccctgactaacacaggccaccgaccctccatcactgtgggcttcctgtttctgcagtaagcactccctttgggagagtccaatgagaaaaaaggaaagaacctcattaggtccctccacgtcaacactgactgtgttaaccctaattactgcacctgaattattcttttccagttgcaaagaaggaaatctctaaggtcttttttaaaacctacaaaacttctaaagaatggtaaaatgggaaggcttttttgcattggcaggagcataaataattcctgagggcatctgaactccaaccaggtcagcccagcccagcttccccaacatcccccttgccagggaagaggcagagaatagtaactcaagtttatagagactgtattgttgcctttgatcttcagcaccaccccattgaggtaagcattagctcatacctttggacaagggcaagtcagaaagtgagagggaaagtgagaaaggcatttggaaaaaacagggaggaggacttggtcattgcttcattcatgtattcattgcacaaatatttattggctaccacaatgtgtcagctgtggtgctggaagtggagagacaatagcaagtgagacagagaaggtccaaacctttacccaacggagtgtatagtccagcaaacatttcctgaaggcctgcacctggcaaggcactgctggcaaagcccaagagtacagcaacccagcttaaaggagggtgatccaactttgaaagctgccccttctgtgagcgccctcaatccctcaagcttattctgcctcactaatgattgctctcccttccatggtctattgtaccatctttctctccctattggcctgagagctcttccagggcaggaccactctccactcagcccaacacaatgtctggcgcacggttcttcaggcacattcatccaatgatgacctgcaatgagccgagcatggtgtcagcagctgaagcaacagagagggaagaaacccaggccccttcctccagggatgtggagtctagtgggggagaaagataaagaaagaagcaactattttgatgtgataaatttcctggggaatgactaagtgccaagctgtgcagaagaagaaatgctggctgggcctggtggttcacacttgtaatcccagcactttgggaagccaaggtgggaggattgatggaggccaggagtttgagatcagcctgagcaacagagcaagactccatctctacacaaaattttaaaaattagccagctgtggtggcacacaactgtagtcccagcaacttgggaggctgatatgggaggattgcttgagccccggagttcctggctgcagaatggccactgccctccagcctgggcaacacagtgagacctagtctcaaaaaaaaaaaaaaaaaaaaaaaaaaaagccaaaaaggagagaggagggaggagagaaaagaggagggaggaaggggaggtcaaggaaggaggaggaggaacatagctgtaatgggaagatagggaggaaaaaggaggatggaagacatgctcagatatgtcttcatggctagatggtaagttctgactgggcagagacaatgtctgtttccttagtacctagcaaagggtcttgcactgggtagatattcactgtattttcagtggggaatgaattcccataatagggaatctgaagcccttaaagaaaaccagaatagcaaagaatagaataatgtttactcttttatattgattagaaatgcatactccacatatagaaagtacaaactcaacagagtaaaatctcagagaatggtttttacacatatttgcagtgtgatcagtcaatgttcctgaaagctaataagaatccagtaaccatttaatattaaatgtatggagaagctacctaaatcctagggtcatgttgcttgtcacttgagagaacaccattttcttgtctaactcttatttttattcacattcatgatcatacatgcatgtgcagccacacgaacatcaacatcaatatctggtttctagagtagattctcaaaaggtaggaaaacctgccttgatagcatcttataaaactcagcacattaccacacacagatgcattccaattgtgaaatctctcaggacgaaaagtattctatgggtgatgctgtttttcttttttttcccaggttttgcttattaatgacccagccaggctttctcacattgtcttgtgctagaggcattgactcctcacatcggaaaagtaaaatgcctagaaatgcctaaaggagaaataaaacaaagtggttgatgcttagaaagaaaagtcatccaattcactcacagtgggtcatgctgcttaactcagccacaaggaaatcccaattcatgcaaaaataattctgtcttcattattctacaatccagtgggtgtctatgataatttgagtactcctttcttgaaaagagaagatcagcacgtgtgtctttaacaatacattcctcttggtcttgctgaaatgctgcattagtgactgcatctgattgcactggaacctggctcaggccccctactgatgctcttacaggccattattaatgcgtaccccttcaggggctgtaatttgggactcaatttgccataaaattgtcctaagtgtcaccttagtaatcggagatcacatgacccatgaaacacattgagatgaaagatggcacctcttggaaatgaatgtcaaattttcccccatagtaaaaaggcactagccattgtatttgcagtggatttcactgtgccttgagatggggaggggttacaatgttccctgtgcacatgccttgagctgggcctgctaggcctcagaccagagccttcacctaccacataccctgaagactcaacacacagactctagtaattcagccatccctcaggtggattttgatggtgcttatctttttaaccaaaaatccatatgttttctaacaaaggagttttatcctaattccagatacaaaaagtaggttagatgtcaagtctggcaaaacaaaaggtagtttgattaatcattagggaaatgccaatcaaaaccacaatgagacacaatttcacacctatcaggatggctatttccaaaacaaacaaacaaacaaacaaacaaacacaaaacagaaaatcacaacggttgacaaggatgtggagaacctggaagccttgcacgtggctagtgggaaggtaaaatggtgcagctggcgtagaaaaacagtatggcagctcctcaaaaaaaggaaacccaggatcactattaacatgtgatccagcaacttcacctctgagtacacaacccaaagaaccgaaggcagggacttgaatagatacctgtgtatcagtgttcatagcaacactattcacaatagccaaatgacagtaataatgatctacatgtctactggcagatgaatggataaacaaaagcggatacagacataccatagagtgtcattgagtcttagaaaggaatgaaattctgacacatgctgaacatttgcccatggatgaaccctgaagacatgatgctaagtgaaatcaaccagacagagagagacaaataacgtgtgattccacttatacaagatgcggagagtagtcaaattcacagagacagaaagtggagtggtggttcccacggtggagcaggggtcattgttcaatagtatatagtttcagtttgggaagatgaaaacatctgaaaaatggatggtggtgacggctgaagaacaatgcgaatgtacttaatgccactgagctttctattttaaaatggttagaatggtaaagcatacattatgtaccttttataacaaaatgttttaaggtagattggttgtcaaaatactagaatttcacatttcaatggacgaaagccaaaacgaatgcaatgtgggactgccctggaaaactccaggcatttggacggccatcttgaaactgtgctgtagataaggtagatcaagaccaggaagccctggggagaaggtggcagggatatagagctggagagaaggggaactgtctgcctctttccttcagaaaagcctgcggtgacaacttgttcacctctagccttactgctcgggctgcagaggacgccggcaccagcacctttgtccatctcaagggctctgttggaaacttgagtcaaatcaactaccttgcagccttaatctatagtagttatttttgttgttccttctgttcctggtgacacttggttctgaatttagtctagcagaatgagagggcctgcacaggggccctgctataagttaccttcactcacaaaatgcgggcatccccacccctagttacaacacacatgtagcaacatgtcttcgtatgttctaaagcagaggaaagagccaatggaacttataagctgtagcttataaagcactcttagatgattctaccattttttaaaaaaaattaccatgatttatctggtcatctagaggggccagacacagtatgattatgatgctcttatgaacttcagagcactcctagaggccacttttaatgaagtacaagcctcctgactggagattaagtcaatatcctttatcacactattgaaagcactgaatattttggtatcgactctcactactctatttcaaaagaggctgaagaagctgaaaagctgagcagcacttctcagtttcaagaaactaggaggcaaaaactggagtctaggactcatcaatgagggcctaataattccctccattttggggctgagatctcaaagaactgtaccctaggactaagggtgatggaagtcgactaaaactcagcaacaaattatctcaattcatgaagtggaattaaggtgatcaagactgctagtctgggggaggggtggagcaaaatggctgactacaaggctccactgattgtccccacagcaggaatgccaaattcaacagctatccacataaagacagcatctttataaaaccaacaatcaggtgagcactcacagtccctggttttaattctatcactgaaagaggcaccaaggaaggtagcaaggagagtcctgaattgccagtgccccacttcctccatcgcccaacagcggccatgtggcacagagcaagaacctgtgcactcaggagagacagcacagtgattatgagactttacactgaactcagcactgccctgtcacagtagaaagcaaaaccagactgaactcaactgatgaacgcccagggagggagcattcagatgggcccaagctggaggggaaccgctgtccccgtggggggaatctgagttccagcaagcctcaccaccatgggctaaagtgctctggggccataaataaacctaaaaggcagtctataccacaaggactgtaactcttaggcaagtcctagtgctgagctgggctcgaagccagtgggcttggggagcatgcgacctactgagacaccacccaacacagctaaaggagtgtttgcaccagtccttccccaaccccaggcagcacagctcttggctccaaaagagatccctccattctgcttgaggagaggggagggaagagtaaagagtaaagagaactttgtcttacatcttgggtaccagctcacccaaagtaggatagggcactagtcagagttgtgaagtccccatttcaggtccttcctcctggatgacatttccagacacacccagggccaaaagggaacccactgctttgaaaggaaggacccagtgctatcaggatccatcacctgctggctaaagagctcctgggtcctgaataaccagcagcaatatccaagtaatatccaggtggtggtagccatgggctgcctgtggaaacgggacgaaagagtgggaagagctgggactcatggtttgagtgccagctcagctgcagtagaatagaacaccaggtatatttctaaggattttggttccagtacgtggctcctggacagcacctctggacctgcccagggcctaagggaacccaatgccctgaagagaaggacacatgcctggttggcttcaccacctgcttactgtaaagccccagggcctcgagcaaatataggccatagccaggtagtgcttctagcaggccttgggtgaaactcactactgtgctggcttcaggtctgaccagtgcagccccagtgatagtggccacaggggagcttgtgtcacctcacacccaactccaggtagctcagcacagagagagagactatgtttgtttgggagaaagtaagggaagagaacaagaatctttgcttggtatccagagaacgcttgcagatcttatccaagaccacaaaggtggtacctctatgagtctgcaagaaccacagtgttaccaggcttggggtgccttgtaatacaaacatgacttagataacacacccaagtcctttcaaatacctcaaaagccttcccaagaagaacaggcacaaacagcccagattgcaaagactataagtacctaactcttcaatgcccagacaccaaagaacatccacaagcatcaaaaccattcaggaaaatgtggcctcaccaaatgaactaaatcaggcatcagggaacaatcccagagaaacagagatatgcaacttttcagacagagaattcaaaacagccattttgaggaaactctgagaaattcaagataacacagaaatggaattcagaattctatcacataaattgaacaaagagattaaaataattaaaaagaatcaagcagaaattctggagctgaaattgcaaatgacatactgaagaatgcatccgttattggccttaaagaggaggtagagaaggagatagggatagaaagtttattcaaagggttaacagagaacacctcaaacccagaagatatcaatatctaagtaaaagaaggctacagaacaccaagcagatttaactcaaagaagactacctcgaagcatttaaaaatcaaactcccaaaggtcaacaataaagaaaagatcctaaaagcagcaaaataaaagaaacaaataacccattggagtttcaatatagctagcagccgacttctcagtggagaactgatagtcgagaagagcatatttaaagtgctgaaggaaaaaaacttttaccctagaatagaatatctatcgaaaatatccttcatacatgaaggaagaatactttctcagataaacaaaggctgagggatttcaacaaagactagaactgtcctacaagaaatgttaaaggaagtatttcaatcagaaagaaaaggatgttaatgagcaataagaaatcatctgaaaatacaaaacttactggtaatagtaagcacacagaaaaacacagaatattaaacattgtaactctggcttgtaaactactcttaccttgagtagaaaagactaaaagatgaactaataaaaaataataactacaactattcaagacatagacaatacaataatacatacatttaaaagttaaaaatatataaatttaatatataaatttaaaaagttaaaaaacacgggatgaaattaaagtgtagttaacctaaccattattaggattttttgcttctttgtttatgcaagcagtcttaaaataatgggtaatagatattatttgtaagcctaatggtaacctcaaatcaaaaaacatacaatggatatgccaaaaataaaaagcaagaaattaaatcctaccaccagagaaaatcactttcactaaaagaaagacaggaaggaaggaaataagaaggagaagaccacaaaataaccattgcattgggcctgcctgggtggtccgtgcaacccaagagagtgaggaaaagcagggtggggcaacagcccacccttgagcggggtggaaccaggtgagccctcaccccaggcaagaaaggtggtgagtgattgtacaacgcccccccaggaagccatgcttttcccatggatctttgcaacccgcagatcaggagatccccttgtgcacccagcaaggccttggttcccaagcacagagctgtgtgaactctcgcagctgcttggccatgcacaaagacccaggagtttcttgcatactccaccccgggaattccagtgagacaggagatcttccaagctttcccctaggaagggggctaaagccaggacactaagcagcgtcatcctgcaggccccactcccatagcacctcacgagttaaaacccactgacttggaattctagccagcctgtgggagcaggctggagattgccggagatgaccaagttcccagggggaggggcagccgccatctacatggctcaagtcagccattttggcctgccaactccaggagtctgcaaggtccagaccaaaaggaattcagcgccatgccgcgcagccagctgctgtggtagatcgcggccaggctgcttctttaagtgggaccctgacccatccctcctcactgggtggggcctccctgtgggaatttcataactccgatctctccctgggatggagccactgtggggaggggcggccaccgtatctatggttcagcctgctggctctggaaagtccaggtgatctggaaaagaggggctcctcccactgcagcacacctgctctgccaaggggcagccagactgcttctttaaatgggtcccattcctcctgactgggtaagacctcccaataggggtctccagacaccttctagaggagcatttgggccagcatcaggtcgggacccctgggatggagctcccagaggaaggagcaggctgtcatatttgctgttttgcagccttcactggtgatacctctaggtgcaggagggtccaaggcaactagggtctggagtggacctccagcaaaccacagtagccctacaaaaaggggcctattaaaagaaaaacaaacagaaagaaaaacaacaacagcacagaccccataaaaacccattaaaacgttagcaaacccaaagatcaaaagtagataagtccacaaagatgagaaagaatcaacacaaagatgttaaaaactcaaaaagccagagtgtttcttctccttcaaatgatggcagcatctgtccagccaggccacagaactgggctgagactgagatggatacattgccagaagcaggcttcagaaggtgggtaatagcaaacttcactgagccaaaggaccgtgttctaacccagtgcgaaacagagaagaatcatgataaaacattacaggagctgataaccagaataaccagtttagggaagaacagaaatgacctgatgcagctgaaaaccacaacacaagaacttcacaataatgcaatcacaagtatcaacagccaaacagaccaagcgggagaagaatctcagagcttgaaaactatctggctgaattaagataaacaaacaagaatagaggaaaaaaaaaaggaacaaacaaaacctccgagaaatgtgggattatgtaaaaagaccgaacctatgactaattggggtagctgaaagagatggggaaaatgaaaccaagttggaaaacatacttcaggatatcatccagaacttccccaacctagaaagacaggccaacattcaaattcaggaaatgcagagaaccccagtaagacattccatgagaagatcaaccctaagacacataatcatcagattctccaaggttgaaatgaaagacaaaatgttaagggcagccagagataaagaccaggtcacttacaaatggaagcccatcagactcatagcagacctcttagtggaaaccccacaagccagagatttgggggcaatattcaacattcttaaagaatttccaacccagaatttcataactggacaaactaagcttcataaccaaaggagaaagaagatccttttcagataagcaaacgctgagagaattcaacaccaccagggtgccttgcaagagttcctgaaggaagcactgaatatggaaagaaaaaccattatcagccactacaaaaatacactaaagtacacagaccagtgacactacgaagcagctatataaacaagtctgcaaaaataaccagctagcatcatgatgacaggatcaaattcacacataacagtattaaccttaaatgtaaacaggctaaatgccccaattaaaagacacagaatggcaagctggataaagaatcaagccctatcagtgtgccgtattcaagagatacatctcatatgcaaagacacacacacgctcaaaataaagggatgaaggaaattttaccaagcaaatggaaaacaggaaaaagcagggagagcaaatctggttccagcaaaacagagattaaaccaacaaaaaatcaaaaaagacaaagaaggccgggcacagtggcttatgtctgtaaccctagcactttgggaggccaaggctggtgggtaacttgaaatcaggagtgtgagatcatcctggccaacgtggcaaaagcccgtctgtaataaaaatacaaaaattagcagggcgtggcagtgcacacctgtaatcccagctacttgggaggctgaggcacaagaattgcttgaacccaggaggtaaagactgcagtgaggcaagatcgcaccactgaactccagcctgggtggcaaagactctgtctcaaaaaacaaacaaaccaacaaacaaacaaaaaacaaagaagggcattacatgatggtaaagggttcaattcaccaagaagagctaactatcctaaatacatatgcacccaatatatatatatgcatctaatacaagagcacccaaattcataaagccagttcttagagacctaccaagagacttagactcccacacaataacagtgggagactttaacaccccactgtcaatattagacagatcaatgagacagaaaattaacaaagctattcaggacctgcactcagctctgggtcaagtgtacctgatagatatctacagaactctccacccaaaaacagcagcatatacattcttctcattgccacgtggctcttgctccaaaatcatcacataattggaagtaaaacactcctcggcaaacacaaaataactgaaatcttaacaaacaatctctcagaccacagcacaatcaaattagaactcaagattaagaaactcacccacaaccacacaaatacatggaaattgaacaacctgctcttgaatggcccctgggtaaacaatgaaattaaggcagaaatcaagaagttctttgaagctaatgagaacaaagagacaacataccagaatctctgagatgcagctaaagcagtgctaagagggaaatttatggcactaaatgccctcaaaaagctagaaagatttcaaatacacaacctaacatcacaacgaaaagaactagagaaccaagagcaaacaaaccccaaagcaggcagaagacaagaaataaccaagatcagaagggaactgaaggagatagagacacacacacaaaaaaaacttcaaaaaaaatcaatgaatctgagttggttttttgaaaaaaataaaatagaccactagctagactaataaagaagaaaagagagacgaaccaaatagatacagtcagaaaggataagggggatatcaccactgatcccacagaaatacaaacaaccatcagagaatactataaatacctatatatacataaactagaaaatctaggagaaatggataaattcctggacacatataccctcccaagactgaaccagaaagaaattgaatccctgaatagaccaacagtgagttctaaaattgaggcagtaataaatagcctaccaaccaaaactagcccaggaccatacagatttatagctgaattctacgagaggtacaaagaggagctggtaccatttctactgaaactattccaaacaattgaaaaggagggactcctccctaactcattttatgaggccagcatcattctaataccaaaacctggcagaggtccaaaaaaaaaaaaaaaaaaaaaaaagaaaacttcaggctgggtgtagtggctcacacctgtaatcccagcactttgggaggctgaggcgggtggatcacctgaggtcaggagttcgagatcactctggccaacaagtgaaaccccatctctactaaaactacaaaaaattagctgggcatggaggtaggcacctgtaatcccagctactgggaaggctgaggcaggagaatcgcttgaacccaggaggcagaggttgcagtgagctgagattgtgccattgcactccagcctgggcaacgagagcaaaactctgtcacaaaaaaaaaaaaaaaaaaaagaaaaagaaagaaagaaagaagaaagaaaagaaaaaagaaaacgtcaggtcgctatccctgatgaacatcaatgcaaaaatcctcaataaaatactggcaaaccaaatccagcagcacatcaaaaagtttatccaccacagtcaagtaggcttcatctctgtgatgcaaggttggttcaacacacacaaatcagtaaatgtaattcatcacacaaacagaactaaaaacaaaaaccacatggttatctcaatagatgcagacaaggcctttgacaaaagtaaacatcgcttcatgttaaaaactctcaataactaagtattgaaggaacatacttcaaaataataagagccatatatgacaaacccacagccaatgtcatactaaatgggcaaaagctggaagcattctccttgaaaatcagcacaagacaggatgccctctctcaactactcctattcaacatagtattggaagttctggccagagcaatcagacaagagaaaaaaataaaaggtattcaagaaggaagagaggaagtcagatagtctttgtttgcagatggcatgatcctatatctagaaaaccccactgtctcagcctaaaagtttcttaagctgataagcaacttcagcaaattctcaggatacaaaatcaatgtgcaaaaatcacacgcactcctatacaccaacaacaggcatgcagagaaccaactcatgaatgaactcccattcacaattgctacaaacagaataaaatgcctggcaatacagttaacaagggaagtgaaggaactcttcaaggagaactacaaaccactgctcagggaaatcagaaactacataaacaaatggaaaaacattccatgctcatggataggaagaatcagtatcatgaaaatgaccatactgcccaaagtaatttacagattcagtgctattcccattaaactaccactgatattcttcacagaattagaaaactatgttaacattcatatggaactaaaaaagagcctgtatagccaagacaatcctaagcgaaaagaacaaagctggaggcatcacactacccaacttcaaactatactacaaggctacagtaatcaaaacagcatggtactagtaaaaaacagacacatagaccaatgaaacagaatagagaattcagaaataagaccgttcacctacaaccatctgatctttgataaacctgacaaaaattaactcaagatgtattaaagacttaaatgtaaaacctcaaacaataaaaaccctagaagagtatctaggcaataccattcaggacataggcacaggcaaagatttcatgacaaaaacaccaaaagcaattgcaacagaagcaaaaattgacaaataggacctaattaaactaaagagcttctgcacagcaaaagaaactatcatcagagtgaacagacaacttacagaaagggagaaaatttttgcaatctagccatctgacaaaggtctacaaggaatttaagagtctaaaaggtcttaaacaagtcttaaaagtctacaaggaacttaaacaaatttacaagaaaaaaccaaaaaacccctttaaaaagtgggcaaaggatatgaacagacacttctcaaaagaagacattcatgcagccaacaaacatatgaaaaaaagctcagcgtcagtgatcattagagaaatgcaaatcaaaacaacaatgagatactagttcatgtcagtcagaatggcaagtattaaaaagtcaagaaacaacagaggctggcaagcatgtgaagagaaaggaatacttttacactgttggtgggaacgtaaattagtttaaccattgtggaaaatactgtggcaactcctcagagatccagaagcagaaataccatttgacccagcaatcccaatactgggtatatgcccaaaggaatagaaatcattctgtcataaagatatatgcacatgtatgttcattgcagcactattcacaatagtaaggacatggaatcaacccaaatgcccattaacaatagaccagacaaggaaaatatggtacatatatgccatggaatactatctaaccataaaaaggaatgagatcatgtcctttgcagggccatgggtggagctggaagtcattatccctcagcaaactaacacaggaatagaaaaccaaacattgcatgttctcacttataagtgggaactgaataatgagaacacacggacacatggtgggggagaacaacacactttgggacctgttgaggggttagggggagggagagcatcaggaagaataactaatgaatgctgagcttaatacctaggtgatgggttgatctgtgcagcaaaccatgatggcacacgtttacccatgtaacaaacctgcacatactgcacacgtaccccagaacttaaaacaaatgttgatgaaaaaaaaatgacagaatggctgaattgattaaaaaaagacccaatgttctgttgcctaccagaaacacacttcgcctgtaaagacacatacagatagaaaataaagggatggataaagatattctatgcggatggaaaccaaaaagggacatgagtagctatacttacatcagacaaaacagatttcaagtcaaaaactacaaagagagataaagaagatcattatataatgattaaaggatcaatttggcaagagaatataacgactgtaaatattacatgcacccaacattggagcacacagatatatacagcaaatatcactagagctacagggagagagatagaccctaatacaataatacatggagacttcagtacctcacttttagcattggacagatcttcctgacagaaaatcaacaaagaaatatcagacttaatctgcactacagaccacatgaacctcaaagatatttgaagactatttcatccaatggctgcagaactcacattcttttcctcagcacgtggatcattcttaaagacagaccacatgttagatcgccaagccagtcttaaaacattccaaaaagctgaacaaatatcaagtatcttctttgaccacaataaactagaaatcaataacaagaggaattttggaaactacacaaacacatggaaattaaacaatatgctcctgaatgatcagtgggtaaatggagaaactaagaaggaaattgaaaaatttcttgaaacaaataaaaatggaaacacaacatactaaaacctatgggatacagtgaaagcagtactaagagggaaatttatagctataagtgcctatgtcaaaaaagaagaaaaacttcaaataaacgacataacaatgtatcttaaataaacaacataacaacgtatcttaaataacttggctttggtttgcttttgcaaaattagtagaaaaaaaagaaagattagagcagaaataaataaaactgaaataaagaaaatacaaaagatcagtgagacaaaaagctggttatttgaaaagataaacaaaatgacaaacctttagccagactaaagaaaaaagggagaagatccaaataaataaaatcagacatgaaaacagagacattacaaccaataccacagaaattcaaaggataattggtggctcctataagaaactatatgcaaataaattggaaaatctagaagacatgaataaattcctagccacataaaacctaccaagattgaactgtgaagaaatcccaaacctgaacagaccaataacaagtaatgacattgaagctgtaataaatagtctcccacaaagaaaagcccaggacccaatggctgaactgctcaattttaccaaacacttaaagaactaatatcaatcttactcaagctgattcaaaaaaggtgaaggagggaatacttccaaattcattctacaaagccaatattaccctcatactgaaaccaaagacacatcaaaaaaaagaaaactacaggccaatatcactgatgaatattgatgtaaaaatccttagcaaaatactagcaaaccaaattcaacaatacattaaaaagatcattcatcattaacaagtgagatttattcctgggatgcaaggatggttcaacacatgcaaatcgatcaatgtgatacatcatatcaacagaatgaagcacaaaaatcatatgattatttcaattgatgctgaaaaagcatctgataaaattcaacatcccttcaggataaaaaccctaaaaaatggctatagaagaaacataccttgacataataaaagccatatatgacagaccaatagctagtatcctaatgaatgaggaaaaactgaaagcctttcctctaagatctggaacatgacaatgatgcccaatttcaccactgttattcaacatagtactggaagtcctagctacagcaatcagacaagagaaagaaataaagggcatccaaattggaaaggaagaagtcaatttatccttgtttgcagatgacatgatcttatcatatttggaaaaacctaaagactccactgaaaaactattagaactgataaacaaattcagggaagtttcaggatacaaaaccaacatacaaaaattagtagcatttctatatgccaacagtgaacaatctgaaaaagaaatcaataaagaattccgtttacaatagccatacataaaattaaatacctagaaattaacttaaccaagtaagttaaagatctccacaatgaaatctataaaacaatgatgcaagaaattgaagaggaaacaaagaaatgtaaagatattccatattcatggattggaataatcaatattgttaaaatgtccatactactcaagacaatctgcagatttaacacaatccctattcaaaataccaatgacattcttcacagaaatagaagaaataatactaaaatttataaggaactacagaagacctagaattgccaaagctatcctaagcaaaaataacaaaactggaggaatcacattaacctgacttcaaattacactacagagctatagtaaccaaatagcacagcactggcataaaaacagacacatagagcagtagaaaagaatagaaaatatagaaataaacccatatatttgtagtgaactcattttgacaaaggtgccaagagcacatattggggaaaggacagtctcttcaataaacggtgctgggaaaactggatatctgtatgcagaagaatgaaactagacctctttctcttgccatttacaaaaatcaaatcaaatcaaaatggattaaacacttaaacctcagacctcaaactatgaacttccacaagaaaacattggggaaactctccaggacattggactggacaaagatttcttgaggaacactctaccagcataagcaaccaaagcaaaaatggacaaattggagggcatcaagttagaagcgtttgcacagaaaaagaaataatcaactaagtgaagagactatgggagaaaatatttgcaaacgatccatctgacgaaggaataataaccagaatatataagaagctcaaacaactctataggaacaaaatttaataatccaagtaaaaaatgggcaaaaagatctgaatagacttttctcaaaggaagacatacaaatggcaaacaggtaaatgaaaaggcactcaacattactgatcttcagagaaatgcaaatcaaaactataatgagctatcatttcaccccagttaaaaccacttttatccaaaagacagacaataataaatgctgacaaggatgtggagaaaagggtattctcatacagttggtagaaatataaattaatataactactatggaggatagtttgaagattcctcaagaaaccaaaagtaagctaccatatgatccaccagtcccactgctggatatatacagccccccaaaatgaaatcactatattgaagagatatatacactcccacatttattgcagcactaatcacaacagccaagctttggaagcaacctaagtgtccatcaacaggcaaatggataaagaaaatgtgttaaatacatatatacaatggaatattattcagccataaaaaagaatgagatcctgtcatttgcaacaacatagatggagctggaggtcattatgttaagtgaaataagttaggcacagaaacacaaactgccatgttctcacttatttgtgggagctaaaatttaaaacaattgaactgatatagatagagaataaaatgatggtttccagagacagagagggcagtcaggcagtggtagtgggtaagcagagatagctaacggatacagaaaaagaaagaataagacctagtatttgctagcacagcagtgtgattatagtaaaaaacaatttaattttatattttaaaataaccgaaagagtataattgaatcgtttgtaacacaaggagaaaagcttgaggtgatagacacccccatttaaccagatgtgattattgtgtattgcatgcctgtatcaagatatctcatgtaacccataactatatatacctactatgtgcccacaaatttaaaaataaaaaatttttttaaaggattgctactttgactagccacatgccagaaacaaatataaatcttatctggaagatgataacatttttctatgtctaaattatgtcagtaactttttatatacaatgtttaatactcaattaaaacataagcatagaaagagacaaaaataacatgaagaaaacttgaatgaaacacaatgtacgcttgctacagttacacagaggcctagataatgaaattaccaaatacagactttaaaatagatatgcttaatatagtcaaaaagaagaaagacaaaattgggaattttcacagaaactaggctatttaaaacacaaaaataatttctataaatgaaaaataaaatagctgaaattaagaactaaatggttaggcctaacagcagcttagactcagctgaagataacactaataaactagaagaaaattcagaagaaaatgtctagaatgaagttataaagtcaaaagaaagaaaaaatagaacagggtaagagacaagggggcacagaaagaaagtctaatatacatggaactggaatatttgaagaagcaagagaagggtcagaagcattatttgaataaatatttgctaagaattttccattacagatgagataaatgaaaccagcactattcaaggacccctacaaatgccaagtaaaataaatgaaattttaaattaaacatcataataaaactgctgaaaagaggagaaaacagattactatgtggggtaataaaacagattactatcaaaggagcaataagaccgggtgctggggttcatgcctgtaatcccagcactgtggaaggccaaggcgggtggatagcttgagttcaggagttcaataccagactgggcaacatgtgaaactctgtctctaccaaaaacaaacaaacaaacaaacaaaatattagcagggcgtgctggcacatgcctgtggtcccagctactggggaggctgaggcacaagaatcacttgagcctgggaggcagaggttgcagagagctgagactgcaccactgaactccagcttgggtgacacagtgagaccctgtctcacaaaaaaaaaggaaaaagaaaaaaaaagaggcaataaaagaacagcaattgactactcaacagaaactatgaaagtcaaaaaacaaaggttatgaggctagattaaaaaaaaaaattccatgctatgccgtttacaagagacatatctgaatgacaaaaatatcaaaagtttaaatttaaaagcctggaaaaagagaactttactagagattgacaaactgcttgtcaaagtggttgtataaattttactcccttgtataggagttcttgttactctacattctgttcaacatttgcactgtcagtttttttttaacttccagtttgatgaatgtatagtaatatcttattgtggtttagatttgcatttctctgattactaatgtagttgaacacatgctcatgtttttttgaccatttggatttcctcttttgcctgtttaaattttctgccatttgatatatttgcctttgttcatcaaagtgtagtttattaaacattctaaatactggtcttttgtaccttgatggcttgtatttacattttttaaaatgtatttttttcactgtcctatcttctatgagagaatcacatactggtcactgactcaaagtccaaacaacagctatgagagagcaccaaacatcccgggcttgtctccaagtttgtgttgtaattgaaacttaattagaccataccatattctgtcagctctgcatgatggggtgtgtgatatatacatatgcacataaatatatgaccagttaattccacgaacttggtggttctggcagaaacaatatggggatggaagactaatcacacacacacacacacacacacacacacacacacacacacacacacacaggaatagatatattctaatctagtagaacaaataatttatccttccagaatgaaaaccatccaacataattcacctcaacctgtttccagatggcagcttggttctactagggaatggtggacttttggaattggtctctgatgctggcaaactgggtattctgcagtgacagcaggtagatcatccttggtaagaggaatccaccttatcaaatccacaaatggtctccattcctgtctccatggttaccttatatatacgtttatggtgcttatatatgattatatattatatatattagatactagtctgtctgtatgtataacttatataagtatatggtatctaaatactttttatataagtacatgccagggaggctgccattcccaaaataaataatcttgtccacctgatgattgagagccacctttatatatcttttacaggataaacaaatgggacacagatatctgcgtattttgtccatttcaagaggtacacccacatacttgtaactctctgttgccaatcttttaatatttctttctggagatttttttttgagacaggttcctgctctgtcacccaggctagagtgcagtggcatgatcttggttgactgcaacctctgcctcctgggttgtagcgattctcctgcctcagcctcccaagtagctgggactacaggcacataccaccatgctcagctaatttttgtatttttagtagagaaggagtttttccatgttggccaggctggtctcaaacaatctttaatatttcttgtcaactatctgaacatatggtctaatcattagccactgccatgttagtatggatctgtacctcaggttattttttatccatatgaggcagaaaaccagatgtacatcttgacgttctgcccattgggaggatttacttttacggtttttcaggaacactcttgatggtatagtacaacattggccaacttctagctgaggacagcatatcataaaggacaatctgtaaatgagcccattatttttctttctctgtcaacttatcataaagaattttctatgaggccaaaagtgtaaattaaaggtgagacagccgtgcagcaagaactggtgtcaagagaacccgagccaccttctcatgcaacttactcacgccttcatgactgattcgaacctgacctctgtatgtaccatttccatttggtgatggattgattgttcatattccaaattttgggtcttgatgaatcagttaatacccacttcatgttagacagctctgttgcaaaccaggtgctatttctcaaaagaattatctacagaagagggagtgcctttgctccaaaattccagggatcttcctattgataaatgccactcagtaaatgggtcagagtagcatagtcaaatgggatctctaacactgaaaaatccaaagtccaccaagtgctatgtcactttctaattggtatattccaaaggtgcaataactcatctttcactctgaagggaataacctcaaattgtctacagtattgtaatttagaaacttcacttctgtggtgggattttggcatgtatggtcttagtagatcagtgaaggaatttgccatttactgttcaccaggccaatttagcagaatgtcatcaatgtagtgaaccaaagtaacgttctgtgggataacaaaatgattcagatctgggaagactagattttgggaacactgacatagtctgaaggcaaaattgtgaagatgtactgctggtcctaccatgtaaaagcaaagtgcttcttttcgtccttgcaaattgatatagaaaaaactaattgaagtcaaaaaaactctgatttccactttgcccatactaattataatgactgttcccaccttctctttggaggttaagttttgtccctctgaaatcttattattctcagtgaaactaaagagcccatttcagggctggcatctctcatcatcctccctgggttctgaagagcacagccaccacggagtttttcaaagatgaaatgctcctctcattgaagcttttttttttttttgagacagagtctcgctctatagcccaggctggagtgcagtggcgtgatctcagctcactgcaacctccgcctcccgggtcccagtttaagcaattctcttgcctcagtctcccgagtagctgggattacaggcatgcgccaccatgccaagctaatttttgtatttttagtagagacaaggtttcaccatgttggccaggctggtcttgaattcctgacctcatgatctgcctgccttggtctcccaaagtgctgggattacaggagtgagccattgcacccgcccactaaggcattttttagtgcattagtaaatggagtgtcctctggggtatatgattgagagctaccttggagttggggtggctgtggggatgtgatagccatgataaaacattccaacattttaatatctttaagtctttgtactgcttcctcttcaacacaccaggaagttctgacttctcaatctcatttaacgagacaagtttaggtctcagtttcagtcaagcaagcaagcaaattgttagagtcagtcttagccatcatgctacatcattaaacccaccatctttattgataaattcagtctgatccagaattatattacatcttcctggctctaataactttagacttatttcttacacatattccccaggatatataagctatctcttcctgaatatttaaaaatcaaggatcatatgaagaaagttggtgatggttaactttacaactggactctggtttatcatgctttttttttttttgagacagggtctggctctgtggccaaagatggagtgcagtggcatgatcttggctcactgcaacctctgcctcctgggctcaagtgatctcctgcctcagactcctgagtagctgggactacaggtgtgtgccaccacactcggctaatttttgtctattttgtagagacagagttttgccatactgcccaagctggtcttgaactcctgcactaaaatgatcctcccaccatgacctcccaaagtgctgggattacaggcataaggcaccatgcctggcctagagtagagttcttaatgtttttggaaatactattcaaaggaactcagggcaaaaaacaaaagcaaagtaaaaaaataaatgacaaactgagagactaaataccacagataagggaaatctccctaatatacaagaactaaagatcaagggaggaaaaaagaccaaaaaccctgagagaaaaatagacaaaagacatgtaaagattgttcacaaaaatatagacacaaggaaaagaaactgtcaacagagtaaacagacaacctacagaatgggagaaaatactggcaaactatgcatctgaaaaggtctactatccagcatcaagaaggaacttgaagttataagaaaaaagaacgccagtaaaaagtgggcagaggacatgagcagacacttttctaaagaagacatacatgtggccaacaatcatatgaaaaaaaactcaacatcactaatcattagagaaatgcaaatcaaaaccacagtgaaatacatctcatactagttagaatggctactactaaaaagtaaaaaaataacagaccctggagaagttgtagagaaaaagaaatacttaaacactgttggtgggaatataaattagttcgaccattgtggaagacagcatggtgattcctcaaagacttaaaaacagaaataccatttgacccagcaaatatacccagtatatacccaaaggaatataaattgttctaccataaagacacatgcacgcatatgttgactgcagcactattcacaatagcaaagacatggaatcaacctaactgcccatcagtggtagattggataaagaaaatgtggtgcatatacaacatggaatactatgcagccataaaaaagaatgggatcatatcctttgcaggaacatggatggagctgggggctactatccttagcaaactcacacaggaacagaaaaccaaataccatatgttctcacttataagtgggagctaaatgatgagaacacacagacacatagaggggaaaaacatacattgggacttatcagagggtggtgggaggagggagaggaacaggataaataactaatgggtactattaatacctgagtgatgacacaatctgtacagcaatcccccatgacacaaatgtacctatataacaaagctgcacatgtacccctgaacttaaaagttaaattttatacagaagatagaaagacagacagacagacacacaggcacacactcagcaaggtgtggtggttcacagctgtaatcctagcactctgggaggcggaggtaggaggatcttgaggccaggagttcaagaccagcctggtcaacagagggagaccctcccatctctatttaaaaaataaaaaagattaaaaagaaaaagacactcaacttcactaattagaaagtgcaaattaaaattacattgaggggccagacacagtggctgacacttgtaatcccagaactttgagagtccaaagtgggaggattgcttgaggcaaggagtttgagaccagcctgggcaacacagtagactgtttctaccaaaaaaaaaaaaaaaattgttgggcatggtcgcatgcacctgtagtcccagctactcaggaagctgaggtaagaggataatttgagcccaggagtttgaggctgcagtgagctatgatcacaccaccgcactccatcctgggtgacagagcgagaccccgtctccaaaaacaaacaaacaaaaaaccccactagtgggccaggcatggtggctcatgcctgtaatccaagcgctttgggaggctgaggcaggtggatcacttgaggtcattagtttgagaccagctcagccaacatggtaaaaccctgtctctactaaaaatacaaaaaaaaaaaagtagccaggtgtggtggcacatgcttgaaatcccagctacttgggaggctgaggtaccagaattgcttgagcccgggaggtggaggttgcagtgagctgagatcatggcactgcctgggtgacacagcaagagtctgtctcaaaaacaaaaccaaaaaactacattgagataccatttcttacctattagcttagcaaaaaattcagaagctggacaatccaatctgttggcaaggctgagaggaaacaggcatggtcatacaacccctcgagaggtgaatttgacaataccctataaaatgacatatgcgtttaccctttgactcaacaactctacttgtagaaaattatcctgcaagatgcatttccagcaatgtgaaaagacagaaggccaagattattcctcatggcattatttaagataacaaaatacatattatacctttgtattgacagatagatgccaatataaatcaataatgggaaaaccctaaaattgaattcaaatagaaacaaacttagatattaaattaaatatgtaatcatacagaaaataacaattcaagtaacttttaaacgtagtattctgattataaaagtttttgtctaaggaaaaaaaacactggaaaggaatctcaaatttcacttaggcttgtgtttgtcatggttgtaatgtaataatttcaaaactattttgtatgtataagggaagcacaaacatggaaggagaaagatgaggaaccaccccagatgttggattttaattggtggattcatgatcttaaaaaggcccaggttaggagcaaccaggttagggtttctaaatatcactcattaccaaaagaaatgagatcagtgagggggtctttgcagtggctgagaaatgaggtgctgaggcctgctcaggggctgggaaacaaggctgaaattcaaaaaagcactttgcgggatgaatagatagaattgcttccctcagtaaaggagaagagagaatcagtaagtgagtttctatgatgaagagtggaaggggccatgatggcattgaactaaatatgaaaggcagagaactggtttttaacatgttttgaatcaattttgaatatgttgactttgagccaatagctttcagatgcttacaaacctccagaagttaagggggtgtcccaatttgggggtagtgtttctggtccttctcctcaaccagtttgatctcttacttacttcagggacagagagggcgccaggggcttcctgaggcttctgccaacgattgcctgtcatagggattacacgatgctccacagacaacgcccagaatcttctccctgcaggatcccagtgggctactcttgagtgagcgaacatcaattcccaattggggcagaaaagcattttcaagacctaactcagggacgggcccccacgtgtggaatttctctttcatccctgcagcgaaggctgactcggggcctctgtggtttgtggctgtctggcttcatcaggctccggctgcccccctgcctgcccagcgctcctgcctggctacagcaagcatgtcctgagcatccattctgagcaggcttcccgggcagccttcctcccctgcactcttggcattcatgtggcatggctataaattatgtccagcatgttcattttcagtttaaatgtgttctcatcccaaaggagcaactaatggcatcaagttactgacgtgaaaaaagcctgccgctacaatgactatggattaatgaaatagcagtcatggaggctggggtggcaataaatcgccagccactggtgacacgaattttaaattttgttctccatcccttgcccccttctccaaaattattttgctgtaaagttgtttggtaaatgtttacctttgcttagatgtttgctttctattaaaagttgatgcaggcagggcccctagctcttagaaaactggaagcgggatgagagggatttaaaagcctatcatgctttctctaggaggcgtgaaggcaaatctcttaatccaggatcatcactgactgataaatttcattcagaaaatttggcaaacacaaggttctttcagtgaacgctgctcatctggcatgtaagttactattcctaccttctgttatgacttttttcctaatgaatttaaaatgaggaacccgtacaattcccaccagtgtttttgaaaggtagcaagtctatttctcatctgatgaagggccccagggtatccactgatgggccacagggagtctcagaatctctgatcctaaaagcaaactgttcatacgtacagttggccctctgtatctgcaggtcccgccatctgtggattcaactaatattgggttgaaaatattcagaaaaacactgcatttgtatggaacaggtacaaactttttccttgtcattattccttaaatgcagtatagcaactatttccatggcatttacattttagtaagtattacaagcaatctacagatgatttaaggtacgcgaggatgcgcatgggttataagcaaataccacgccattttatgtcgggaacttgagcacctgtggattttggtacccaggatgtcctggagccaatccctcatggataccaagggaaaactgtatggttttctagaaagaaggtctttagattcatcaaattcactaaatgttctgtaacatcaaaaacaaacaaacaaacaaacaaacaaacaaaaaaacaaaaacaaaaaacgtaaggctaactatggtggactgcagtgatggctccagtttcttcctccccaggtgtccacgcccttgcaatggtgctctgcagtccctcctaatgaggagcctgtacccatcccttgattctggggtggccttgagattggctgtggtccatgggatactaatatgatacaagcagagttgaaaaagtatttgtacactggggcttgcctccttacagtgcccagaactccacagccacgtgaacaaggctgggcgaactgatgagctacatggcccagtcacctccacttcccagcagacctaccaaccagcaaccacatagagtgagtgagcccactgagaccagcatgcctaggccaaaccagaaggactgtccagctcaaactgctgacttacaataaccttaaaaaaaaggttattttaagcaactaagttctggggtagtttgttatgcggtaaagctaactgacttgctaggttggggaagttctcctggataatatcctgaagagagatttccagcttggttccattctccctgtcactttcaggtacaccagtcaaacgtagatgtggtcttttcacatagtcccaaatttcttggaggctttgttcatttcttttcattcttttttctctaattttgtcttcttgctttatttcattaagtcgatcttcaatctctgatatcctttcttccacttgattgatttggctactgatacttgtatatgctccacaaagttctcgtgctgtgtttttcagctctatcaggtcatttatgttcttctctaaacttgttattctagttagcaattcattgaaccttttttcaaggttcttagcttccttgcattgggttagaacatgctcctttagcttggaggagtttgttattacccaccttctgaagcctacttctgtcaatttgtcaaactcattctccatccagttttgttcccttgctggcgaggagttgtgatcctttggaggagaagaggcattctgggttttggaattttcagccttttttttttgctggtttctccccatcttcatggatttatctacctttggtctctaatgttggtgaccttcagatggggtctctgagtggacgtcctttttgttgatgttgatgctattcctttctgtttgttagttttccttctaacagtcaggcccctctgctgcaagtctgctggagtttgctgaggtcctctccagacccggtttgcctgggtatcaccagcggaggctgcagaacagcaaagattgctgcctgttccttcttctggaaggtttgtcccagaagggcacccaccagatgccagccagagctctccggtatgaggtgtctgttggcccctactgggaggtgtctcctagtcaggatacacaggggtcagggacccacttgaggaggtagtctaacccttatcagagctcgaataggcaaaaactggaagcattccctttgaaaaccggcacaagacaaggatgccctctctcgccactcctattcaacatagtattggaagttctggccaggacaatcaggcaagagaaagaaataaagcgtattcaaataggaagagaggaagtcaaattgtctgtgcttgcagatgacatgattctatatttagaaaaccccaccatctcagcaccaaaatctccttaagctgataagcaacttcagcaaagtctcaggatacaaaatcaatgagcaaaaatcacaagcattcctatacacaaacagagagccgaatcatgagtgaactcccattcacaattgctacaaagacaacaaaatacctagaaatacaacttccaagggatgtgaaggacctcttcaaggagaactacaaaccactgctcaagaaaattagaagatacaaacaaatggaaaaacattccatgctcatgaataggaagaatcaatatcatgaaaatggccatactacccaaagtaatttatagattcagtactatccccatcaagctaccattgactttcttcaccgaattggaaaaaaactactttaaatttcatatggaatcaaaaaagagcctgcatagccaagacaatctaaggcaggaagaacaaagctggaggcatcatgctacctgacttgaaactatactacaaggctacagtaaccgaaacagcatggtactcgtaccaaaacagatacacagaccaatggaacagaacagaggcctcagaaataacaccacacatctataaccatctgatctttgacaaactggacaaaaacaagcaatggggaaaggattctctatttaataaatggtgttgggaaaactggctagccatatgcagaaaactgaaactggacccctcccttaaaccttatacaaaaattaactcaagttggattaaagacttaaacataagacctaaaaccataaaaaccctaaaagaaaatgtaggcaataccattcaggacataggcatgggaaaagacttcatggctaaaacaccaaaagcaatggcaacaaaagccaaaattgacaaataggatctaattaaactaaagagcttctgcacagcaaaagaaactatcatcagagtgaacaggcagcctacagaatgagagaaaaattttgcaacccatccatctgacatagggctaatatccagaatctataaagaacttaaatttacaagaaaaaaacaaccctatcaaaaagtgggtgaagtttatgaacagacacttcttaaaaaatgacatttacgcggccaacaaacatatgaaaaaatgttcattctcactggtcattagagaaatggaaatcaaaaccacaatgagataccatctcacactagttaaaatggcaatcattaaaaagtcaggaaacaacagatgttggagaggatgtggagaaataggaacacttttacactgttggtgggagtgtaaattagttcaaccattgtggaagccagtgtggtgattcctcaaggatctagaaccagaaataccatttgacccagtgatcccattactgggtatatacccaaaggattataaatcatgctaatataaagacacatgtacatgtatgtttaatgtggcactgttcacaatagcaaagacttggaaccaacccaaatgcccagaaataatagactggattaagaaaatgtggcacatacacaccatggaatactatgcagccataaaaaagaatgagttcatgtcctttgcagggacacggataaagctggaaaccatcattctcagcaaactaacacaggaacagaaaacccaacaccgcctgttctcattcataagtgggagttgaacaatgagaacacacggacacagggaggggaacatcacacagcggggtctgtcggggcagtgggggactaggggaaggatagcattaggagaaatacctaatgtagatgatgggttgatgggtgcaaaccaccatggcacgtgtatacctatgtaacaaacctgcacattctgcacatgtaccccagaacttaaagtataataataataataaacctcaaatgagagggaaaaaaaagctaactgatacaagtaccagaccagacagtgtccgtttggaagatggggatgtgtcttattcagtctttgtatctcctttccctttaaaccctgtaaccattcaatatgtatttgttgaactgggtagaaatggccccttgaaaaggctgcaattaaacccctttttctcaaggctactcaagtcaatcaggagggaaacagcacaccaaggattccatttcctcatttttataaaatgggcttcaaaatacctaccttgtcatgctgttgtggttgttaaagatcctgtgtgctttagagatgtccttgatacataatagacggtggctcaagcagaaacaagcttatggaaaggctttagaactcatcaggatgcaggatattgtatattttttttctatcaaagtggtcaccatgtgttcagcctaagaggactccagtttcaagtcatcagctttctctgttgtagaagtaaggttggttccttcacgctccatcagacatccatgtgccattctaacagtgcctcgtcagaggacttgcggcgccctctgtgaaagacggggagggctcctgagcgggactcaggaatgtgggttgctactctggattctgccaccgcccatttccttgcttgtgaaataaagtgtggatgactgcacgctctctaagaatcctttcaactctaggaatccacgggcttcagttaccaccagtgtcatctaagcgtgagggactgcactgctcacaggatccctgagccataagacaattgacatttttagaagtggaaaagaaaaggttttctgtatttgtctaaagtagaaaggcagaagaacaggccaaagaattaggaaataataaagaggaaaaagcaagcaagcaagtctgatttgagctgggatgcgagaaccttgcttgctgcaggataatggagctttacaccgtgcataccacactcacacactcacatgctgaaccacacatttggctaattacagaaaaaatttcaaggaaaaaaaaaagacatacacaaggagttataaaatgctgatgagaaaggtttacacaaagagctgtgagacattcgaaaaactggtttttggcattaagacttcctatccttttctagtaatatctaaaatggcttcttcctagcatttaggataaaacttcttgtgttggagaagtatttggaagtaaataacaaacacaaacatcatttatcacaaagagcaaaagatgacatctcaaaattctgcttcttgccaaaatggacattaagtttttgcttggaagcaaatgtgaaaatagtgacttttatctaattatccctacatatatccaaagagaaagttataacttatttgtcatgcttttaatatgattttctgtcttgaatgttggtattttaaacattaaaatcgccaatgagtaagcaaataagacaattaccagatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcggtggggcaagagcatgcgcagatggagtctggagggacggctggagtggagtgtgtgggacctgaaggtggtcgtaaggctccgcgtgcggctcgtgcccatggcgactgcgcagaagacaggcggggttttttttctccctctaacattgtattacgatcattttaacgcatacggaacagttgaaaacagtgcagtgaacacctatatacctccgcctaaatcagacaacctagcactttgccatttctgctcgtcactctctccccacctgtagctatgtatacacgtattgtcgttaaactatttcaaagttgcaggcatcatgacatcacaactagtactttgcactgtaacttttttttgttttaggacggagtcttgctctgtcgcccaggctggagtgcagtggcgagatctcggctcactgcaacctctgacctccgggttcaagcgattctcctgcctcagcctccatagtagctgggactacaggcatgtgcaatcctcccgcctgggcctcctgactagatgggactataggctcacgccaccatgcctggctaatgctttttactttcctccagagacagtctacctatgtcgcccaggctagtcgcaaactcctggcctcaagtgaacctgaacctcctgcctcgacctctcgaattgctggaattacaggtgtgagccaccacacccagcttaattttcttttttgtttttggggtttgttttgttttgttttgttttttgagacggagtctcattctcgcccaggctggaatgcagtggtacgatattggctcactgcaacctctgcctcccgggttcaagcgattctcctgcctcagcctcttgagtagctgggactacaggcgcctgccaccacgcccggctaatttttgtatttttagtagagacgaggtttcaccgtgttagccaggatggtctcgatctaaccttgtgatccgcccgcctcggcctctcaaagtgctgggattacaggcgtgagccaccgcgcccagcccacccggcctaaatttcttagtttggacaaacgtgccatggtaatgcaaaatgtcattattaagggcagctggatggaaggtgtaggagtacactatagtgcctttcaatttttctgtgtatctaaagtcatttcaaaagtaaacatttattttaaaacatgaaggtggttatgcttccatgagtgtaaagtacaaaaggcaggctcgtggtgctgtcagaagtcagaacactggtttcagggctgggggtgttgggaggggctgggcatggttggctttgtgatctgggggctggtgtgttccatctgtgaatatcttttaagctgtgcacttaccagggatgtaagtcatatcttaataaattttcataagtttgacaaaaaataaaatgaggatgggaagcttgtttgggttgtggggcctcgggtgcttatccagccatgagctgtgtcccagatgcttctagaagcctggagggagctgagaacattccaagtcgaggtggcagagccaaggccctgaggtgggagcgcaatgctgcacatccccagctgtgaatggggtgtcctggtcagaagcagtgctgtgtgcactgcagggccggcaaatccacgtccacattgtggcttggtgcagtgaaagccaatctcagccccctccacagtgtgattagcctgccagcaggtggccagctggtcctcctgggaaatggtgccaacccagagactgggtgcaagtgtctcatccacggaggggcgctcagcagtggtgtcagcctggtgagcctcggtaagggcacgtgcaggatgctgagcctcttccgttcccatgcccgtctcaaggccacttgctccgtgggcccatccagcaagcatggtggccaggaaagaagccggctccattcacagggcgtgctgttttgctcacctcaggaccaagagcatcctccatagtgattctctttggtgggagcactagaaacatgaaccacagataccttcagcgtctgagccgctgaggcgagggctgcaggacaccctgctgtcgggaaaccctgcactggcggctggaaggcatgtggtggtggcgcctgctgtggctgcagcagttgctgcgaggcttcgggatctcgccggcccctgcgaggtgaattgtgacagtgcagagctccgtggtaccagggccccctgcatggccatgctgactgcagctgggagcccaccacacctctggttccccgctcttcccagggctggggtctaggccaggcccctcttggcctgcgaattgtgccctgggagggggacactgttccacaggttgggaccaaggacccagggcatgctactggctggctgggctgcagggatgccatgctcacctttctctctcatggccttgacgggaccggcttcctcattgaacagcattttccaaggtgtctgggattgctggtggggtgccaccctggctccttctaggcatgcccgtcattggccaccaagggggccagatgcaggtgcccatgctgctgtgggggcatctcccaacttccctcttagtcctgatgggcctaggcagggcctgatatgggggtccccatgggcttccggggctaagcctgccccatggtcccagggctgtccaggacacattcagaagggacatgagctcagcagctctgtttgaaattattatggaaccaagggccccccacatccaagtccactgggagtcgggacatggagttccgctgcaggtacctccaggaaccccgaggtcctccttgagccaaggccaggctgggcacaccataagtcctgggtcccccagagaatggcctgctgccctgggctccccagaagccccctcacgcccctgggccttggccacatggaagccccaccaggacaggtgtgagaggacaaggaacccatggtggggaagcagaccaaatgggccgctggaaccaggctggtgggccagggggcacctgcccatcccccttgcagagggccttcctgccacgtgaagccagcacagccctggctgctgaggacccttgcctgggtttggctgaaagaaaaacagacgtgatcaggcagcacctccagtgggcccaaagagtcctttctgggccgggccccacctgcctgggtctccggagtcctcagggtctctcggtggcccctggggtctgacactgaggacacacctgcaggctgctgatcccagagggaggggtgtgtgtcacctggggtagggaagctgtcggggcacagcaggtggctcctgggactgccccccaggattcaggctggctgggggcttcctgccccatgccctcatcccagggctgttgggcctggtatatgatccccagtcagaactcaggtgggaggggccttggctgtcacccagcccccttgctacctcacttggggacctgtctctaccatgagtaagagggcccagatacggggccccctctgccctcctgggctgcccggtccatgccaggactgaccattcccacacctggctgaactcttggctctggctctgggccaggggtcccacctgtgcccttgccctgaaagctctgggggtcagggacaccgactcccttgtctccctggctcaaggctcgttgtcctggcacccttggagggatgttcaggagtgaggggcctctgctgctctctgaggctgtcagtgcttgcagggaggggtggggggggtcccacaaatgggtctggctcctccagtgccgtcaagggccctgttgggggggggcgggacaccgtggaaagtgggagggggcttgttggagaggtcttgcccacatccccctcctgcgtgcacagcatgtgcagtgcacatgcactgagcacctgccctgaggaccgggggcctattgtctttcttagagtccaggaggaaaaggaggaagaaaaggcacaagaggaaggcccaggtagtaggcttgggggtcccgggcgctcccccactattgactgccccagagggtgactcaggagggggcctggtatggaagcccatctgggggtggcaggtccccattcttccttgttagcttcctcgtagaggcccaagggtgcccgagagctgcgtcttcatccagggcctaggtatgggagaaccagcccccaaaactgcccatgggccagacctggatgtcttcatgaggccctctagggatagggtgggcatcaggccaggagagttccctgggagggtcagagcccatacctcattgccacctcaaccgtctcccactgggaggtgccagatccttttgtggccaccccaggggtccagatgtgcataggaggctgtggctgggggtggcctgggcagggaagtgctcaccacactccagactttcatctggaacatgtcgggggtgggcttggtgtcactgtgccctgcccagcccacccagccagacctccccctgggccagagcagaggatcatggggacagtgtgaggaagctgccctcaggccagtccgagtctgaccccagtgctccccagtgccattgggcacacgtggacttactccattaaaccttaaaggcagtgcatgccatcggcatcaacacctgttccccttctaccaaatacacatcccacaggtgcaggttgagcctgagagagatctatggggacagcagacactggaggacctggcccttcaaggctgggggctggtggctcgagctgggcccactgggacttcagtccccagagtcagtgaccctccccatgagggtcatctgacccttccaggaggctgggtcagacagggtcttgcagctcctcatgaggggcactcatttcagtgggatatggcttctggagagagggacctccccagggcttgaggcttctgagctctcccaagttgggttctgccccagtcttcccatgaggctgggcctgagccccaacctctgccgtgggatgacccttcttgggcacggggccttgcttgtgtgtcctacagggccccgtctgtgcctcctgtgggctgggggtgagccggacccctgggcacggggagcagggcactgcagggcaaagagggtccctgagccagggtctccctgggcctccttgccccatccatcaagctctggagcagccagcctaatgaggaaccctgcgcacatggcccttccttgtcgtgatgggaggaacagaagtgctcagggccccctgggctactctaaaaaccaaacctccctcttccagggtcctctgaagacccttccccaagtgcagaacacaggatggtgtccagggctccacacgacaccttccccttcccgcactcccagcggacacactgcccttagccttgctctgcaggaggtgggccccagtgcctgtgcctctgtctcctccagggcgggaaaggaaacccaactccaaacgcatggagaaccccacatcccaggtcaggccctggctgggactcagcctctcatcagtcccatgggggtctctagccagccctacgggatgcagggcctctgggaaagagccgaggggaccataaacacacagggtgcctcgtggtcttgggttatgacgtgggtaccacgtgttcctggtggtcttgtagcccctggacccttgtgctatttgggctgtagaatcctgagacgcccccagcccatcatgaaaccagagccagctcccaagatgtggagctgtcagctggaagaactgggcagctgcagaggcccccgaaccccgaggcctcccaccctcccatctgtgaccccaccatgtggccttggccctggggagaaggggtgggaacatcccctggagcctggctggaggtgctccgggaggcctcctgggccagggtgccgggagggcaggcctgactttgaggccacaacagagagtagaaagaacaaggtgggtgctgggacccctggttgtctcttggaagtggggtcaggccaggggacatgggatggggaggtgctgccatctgggctttgtcagcccacctgtgggaaccaagggcagctgaagcccagccagctggaggccaggaggactctcagggaggggagagtcagctgcatagaattcgagctggagagcgtggctccaggacatagagggcggccacggcgaggatgagatgccctctgctgatggggatgaaaggcatctgactcagggtctgggggtccccattcatccatggtctcctgtgggaccttcagcagagacatcctaaaggctcccaacaagctggtgacacaaggaaggtacctttgctgaaagtcgagatcatctggctagggtggctgtccccgggtctggctgcatgaggtcggggggcagctgttcacctaccctgtggggagtgcctctcacaagccaacagctgggccagtgcccagaatgcatcctccccaggcccataaaggagaaacaaggcagcagcgtggctcaggtccctgcggtagcccacctcctgcaagatccagagtcaccatggaaggacatctcctggagggctgaggtcacctgggaggactcatgtcatcggagagggcagaggtgactggggaggcttcctctgaagaagaggcttcctcaggatgcaaatttattttctgacaagagccatgtccatcaggcacttcagcaacttgtccaaaatgtttcctgagagcactgtcctgcatgtgacactaccaagctcctgggctttggggcagccccaggaggagggtgtcatttcttgttatgaaaagtggtggtcaggcccaggtgacactagtagttggggccctgacttctttgtctcagtttgaccccttgagaccacctcccttgcttggagatttatgccaacggtgagctggagtcctatctactatatcctgatgggtcacaaatactgactttgaaagaaacaacgatgcccctaccagacacccacgcccacgaacgtgggaatatggcccagaaacgtcactgcctgggaatactcatggggttatatgccaaatataccaggaagatgtagaataattcctgctgcctaggaaagagataaaaggggctttcgtttgttttgtgcagacgcttttagtttcactttgcctacaaaccctaacaacaaatccagtttcaggttcagatgattcaccagataagtcacaagctcttcaggaccttggttgtttaagaaatgtttcaggccaggcgcggtggctcacacctgtaatcccagcactttgggaggccaaggcaggtggatcacgaggtcaggagatcgagaccatggtgaaaccccgtctctactaaaaatacaaaaaattagccaggtgcagtggtgggcgcctgtagtcccagctacacaggaggctgaggcaggagaatggtgtgaacctgggaggtggagcttatagtgagccaagatcgtgccactgcactccagcctgggtgacagaggaagactccatctcaaaacaaaacaaaaaaaaaaagtttcagtaaaatccacatctgtgaaatgcagatatcccagttgtatagtgagttgactgatcacactctgatttttattttttcagtttgcacacccaccagttcagtctttggggtgtacagtacctccatggttctaaaccaatgtgcagagtctcctggtcaccactccagcccctcctggagcgattccttcatcctccaagtctccagggtgtcccctatgtagccaacctcttcccggtccatcagcccttggccatcccaacgtgttttctgtccctgtgatttggccttttccagaatggcctattaattggaaccctacagaggtagcttgttgggtctggtttctttcccttagcaaaatgcaactaagatccactgacgttcatgtgggcatcactggctcattcacttttctcactgagtcttttttcctttgaagggagggccacccatcctctccccattcccatgttgaaggttgtccccatggcctctgtgtgtgagtgacgatgaatcaagcagtgaatgtggcatgcatgtttcatgtgtgttaagtaaaatgtttatttagaaacagaatgcttgatccttagtaccacaaagaaacatcagcatttagacaaaaagttttctcagcaaggcaattttaccttctgcagaaagggtgctcctcacagatggaacaatggtgagagcacacctgaataaaagagggaagcaatttttatcctttatgcagcttgtccctgctactgtgtcctgtctccattggctggagctgggccatacaatctaaactaaatctgactggctaataatttaaaatgtctctaaatagctgaaagcaatggagaacaaaggaaaagaggaagctgcttatgaaaagacttagaaaagtaataacattcccaaataaggaaggggcacaggcttcaagctgggacctgcctgtgagcacgtccagcacagataaccctgattgaagtacgaggacatagaatgtacttattcctttatatctaacagctgtgtagaatagggcttaacaaagagttattagcacaaagcaaggaggcttgaaggaaattagtctttaaaggaaactgttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtgtgcaactgctctggaacacagaggcaggctggagggcgagcgggtgctcagcaccagtgacattctgaggtcatggcacacatcacagtggggccttgcctgggtcatcagagcccagagtcagcgtcctccactgcctgaggcgtcaacatgcctgcatgcaatgtgtgcacttgtgtgcacatgtgtatgtgggtaaacacatctgtgcacctgtgtgttgcttctctggccaggcctggctgccccactcatgtctgcacccagttcctcatcactgttacccccgaggcccaggaccagcatcagagcatccatgggtgctccctaacttcagccctccccaaccagggtggtcctgggatacacataggggtggagggaagttactgttgctgttgaatatcagaataaaaatgttaatactattacctaataacctttcagtatctgtaggaactcttaatggtatccctttttgtatttctgatattttaatgatatgtttctctccatgacccttggttattctaggtagagggtcctgtggggaaagtgcctggcaccctgtaggggctcactcttctagaaatgtgatctgaaatctggctcacctgtccttccacccagggcctaggggatgccgagttccggagaccagaaagagcttgggataaaaagaaggtttaaggggaaggctttgacctgggctgggtttgcctgcgccatccaaacctgcaggctcgagtcctgagacacagggggtccagatgtcccaatgcagggccctcctcattaacacctgctcccctgtactcattagtaacctcacccatcctaccctcaaagcacagttggccctggtatccgtgggctctgcatgtgtggattcagccaacagtgggtggaaaatattcagaaaagggagtgtggatggctatgtctctgctgaacatgtacagacttttttcctgtcaccattccctaaacaatacagtataacaacccaatgacagccctagcaagtagagacaatgaaaaagaccggctcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaacacacatgagaaaatgctcacaatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagacagtttggccattcctcagggatctagaactagaaatatcatttgacccagccatcccattactgggtatatacccaaaggattataaatcgtgctgctataaagacacatgcacacgtatgtttattgtggcactattcacaatagcaaagacttggaaccaacccaaatgtccaacaatgatagactggattaagaaaatatggcacatatataccatggaatactatacagccataaaaatgatgagttcttgtcctttgtagggacatggatgaagctggaaaccatcattctcagcaaactatcacaaggacaaaaaccaaacaccgcatgttctcactcataggtgggaattgaacaatgagaacacttggacacaggaaggggaacatcacacaccggggactgtggtggggtggggggcggggggagggatagcattaggagatatacctaatgtaaatgacgagttaatgggtgcagcacaccaacatggcacatgtatacatatgtaacaaacctgcacgttgtgcacatgtaccctaaaacttaaagtataataataaaaaaaagaagaaaaagaaaaagaaacagacctgctcacattgtccagctttgaagtcttggaagaagttgccaccaggatgcaggtaggggtcaatctcctccaggatccagagagcatatcagccagcttcagggtcaggaaaggagcctgacaggtctgcagtaggacggggctggggctggccgtgtggatcacgtgggcctaatgagggggaaagtaagaccatggggcaaaggagggagcatgggggcagctggtggcctaagcagaaggaacttcagagaaggggtctgcattagttcattttcacactgctataaagaaataccagagactaggttatttataaaggaaagcagctaaattgactcgcagttcaggaaacttccaatcatggcggaaggcgaaggggaagcaggcaccttcttcacaaggcggcaggagggagtgagtggagaatgaggaagctccacattttaaaaccatcagctctcctgagaactcactcactatcaggagaacagcatgggagaaactgcccccaaatccaatcccctcccaccaggttcctcccttgacacatgaggattacagctcaagatgagatttgggtggggacacagagtcaaacctatcagaggctcactctgtctcgtggctcccccagggctcaggctgagtgcagatctgatctgctggccctgctctacagcacgctggggctctgcctgtgcatccccatctgtggcttcccggcgtggcggcctgttccctcaaaaggagggtggctctgctctcctgccagccccctgcagggcacgatggagccctggccacgtcctcccagggtgagggcatgaaactgggctccttgcccttcttgctgcttgggtgacaagctttgggtcatccctaggtcctgtcactgttcctgcttctaaatggagagcattttgccacatcttcctgggagaggctgggggttcgtccttgttatttgttctatcttggtaaaaccaggttaagttatctgggcaagcagacaatagagtggcacccaggaagggtggggtgtagggtgctggcctttgggcttgcctggaccatggttggaggggggaaggttaccaggaagcaggactgtcagggctaaagtcaggaggaagtggttatgctgaggggggaggtgtgtggctggcttggggcaggacgtaagtaagagccaagctctgtcagctcacagagagggccgctggcacctagtctagaggctgtggagcccaggggttgcccttagttcctggatccagggagacttctggagcctgtgcctatggctttcaggcacagggtgaagctggtgagggcagggggaagggtgagagaggaggccttgcatggcagggcaggacaggaagctggccagagaccagtttgcagtggctgctcccatcctcacccccacccccaagcacacccctaccccagctgggcctgggcacgtgtcctctgctttggtctcagcagatcacaagatggaagctggcagcctagtgggtgtgccactcaagccagtggtgacctgtgacttctgcttcctggatcgtggggtgcccacccaggagagcacaggtatgccccacacccctgaccttgagggcgctgggaggtgggggaccaatgtgctctatccctgtgtgtatgccctgaaaggtggcctaggagtcctgtgtgcgcccatccacgtggggtcccaggagcttcaacggtggcagggagggagacgaggagggagaaagaagtggagaagaaggagagagaaagagagttggggagaagagagtgagacagaaagagaggaagagagatgggggaagaaacagagaaagagagatagggagagagacagaggaggctgagaggaagaggagagagagagatagggagagagacataaaaagcaaagagagagacagggagagaggtgcatgagtaggaggtcgggtcattcttgatcacagttccagggcaacctgtaggttgccattaactaaccacacatataataaaggcttctgcctgctgcttacagccctcaagaacctctactcctggagactaaaacctttgacggctgcccttcctcactggatgtttgtcgtgtcttctgacgaaccgtgatgcctctttgtaggaatggtatcaataaagagccagatttgaggaggagagtaacgtgaggcattccaaaccattttcagctgaaaggtctttaattaaggtttcaaactctttagtagttggattgctggcgtcatcagtgctggtgccctccttttctttctttgattcattgtttaaatctgttgaggattgaacaactgtgaagttgacctgaatagcaccttcactcctgacagtcacatcttggtaactggattatacctataataaaggaggcagatcagaaccacagtccttcagctggagtaccccagccctgggaaaacaggtgtgcagagaatgtgtgaatccttgggataaatgtggtgcatcttcctaaagagacattttcatgttgagcaatttattatttttgatacattaattaataaataaaactcaggggacaggcttgcctgggaggacttagcgagtctcacagtgtcctcagggtgccgggaatgttggctttgtttcaaacccatttcctttcacagagaacctagccatcacatggggctggatgaggtccaggggcaactgagggttcctggccaaggccacaccctagtgttacctgtaggcttctgaactaaccccagcctctgacagcccaatgggtgatggcaaccgggtctccaagcttcttctatcgcaattttcctcttctccttttcatgaccaccatatctcctatccactctctgtatgcaatgctgcaggaatttttacagttcagggaagtaatcctgttaggcgagatcaggaaatgccataagggattgctgttttcttgattttctagaaacagagggcctccccaactgcccccaaacccccaccccactgcagtgagcatctctctctttacccttggtctggagagcacatggtatttcaaggtcaaaatcgccacctagcggagtaggaatcctctccatgaggcacattgtcagccctttgcagaaacattccagcttcccaattctccctttttgaacccctctactagacaccaggctttctgccccttcagtaaatgggaaaactcaacgatgagaaggaaaatgtcctccaaaaccaaattttaatcttgatactgtcccatcagcaggaaaaccaccattcagtcctacgttctttcaaggcaccagaatattctgcctccaattaaaatggtacttaggctgggtgtagtggctcacgcctataatcgcagcactttgggaggccaaagcaggcagataacctgaggtcaggagttcaagaccagcctggccaacgttgtggaacaccatctctactaaaaatacaataaatttgccaggtgttgtggcgtgtgcctatactcaggaagctgagacaggaaatttttttttttttttgagacagagtctcgctgtgtcacccaggctggagtgtagtggtgcgatctcggctcactgcaacctccaactccctggttcaagcaattctcctgcctcagcctcccgagtagctgggattacaggcacgtgccaccacgtccagctatttttttttgtatttttagtagagacggggtttcaccatgttggccagaatggtctcgaactcctgacctcatgatctgcacccccctcagcctcccaaagtgctgggattacaggcatgagccaccatggccagcgaggcaggaaaatttcttgagcctgacaggcagaggttgcagtgagccaagattgcaccactgcactccagcctgggcaacagagtgagactccatctcaaaaaaaaaaaaaaaaaaattaataagtagattttatgcccggaagttaactggagccactacctaagaataaatactttagtatagaccataataacaaactgtagagctcaaaccagcacactccctccattaaggggccttgcccaaatgcaactgttacatagtcctccccaagatctatctattggggaaccacacaggtcacacaagtctaagaagtcaaagggaaatcaccagcagaggactagagtcacatggatgaatgtgactaatccctttgcttagttcctccgattccatggctgagggtcatatctgcattactgggcagcacctttaacagatgccagggctcagggaaccaaggaaggaaaaacagttggggggtcgaccccactgtcttcccctccatcctgagccattgaaggagggagaccaaagggatgcctttttcttgcttctctttctagatgggtaaagaccaacttcagcctgtacttctctggaatgcattctgaatcactgggactcctttgaccccaagactttgaaggaaaagcagctcattttcttttgcgcaagggcatggccttcttatcatcttgaaccagcctggcctgtggaggggagctttgattttaatactatccaacaattagatcttttctgcagacaggagggcaaatggtccgagatcccctatgtacaagctttctttgccctgcaagacaacccagacctttgcaagtgttgcacaattgactcaacttttttagcagtcatatcagacgggccaaaagggaatgactccccaaaactagagaagcaacttccaggggaacaatctgaggcagctattgagtgtccaggcccttgttgtcccccttctctggggccccctccaaccatgccattagctccttcagccctaccacctctgaaactccccacatccccctacaggaaatgcccaatggaggtgatgccactaaggttcaagttcccttctaattgcagaaccttaggaaaataagggaagacttaggtcaattttctgatgacccttatagatatatagaagctttccaaaatttaactcaggtgtttagcttctcatggaggaatgttatgctgctcctaaaccaaacacttactacggctgaaaaacaagcagctctgaaggcagcagagaaattcggagatgagcaatatgtctcctatagtaggccaaaaagggaaagagaaaatagggaaagtgaagaaaggaagaacggagaaccatcattcccaataggaagaaaggcagtaactcctgacaaacctgattggaaccccagtgataccacagatgaatggaaaaggaaaactttttaatgtgcatattggagggcctacaaagaactagggccaaacaccttaattactctaaattgtccatgataggccaaaagccagatgagaatcctgcagcctttatggaaaggctgagagaggcactaataaaacacacctccttaacccctgattcagtcgagggacagctcatcctaaaggagaagtttattacacaagcagctcctgatattagaaggaaactgcagaagcaggctataggaccagatagtaccttggagaacctgttgagggtagccagcttagttttttataatagggatcaggaggaggcccaagagaaaggaaggaagcacaagagaaggacagagactctagtagctgctttgcaggcttgcaaagtccaggatccccgaggtgcatatgctagttgctactaatgtgacaagtcggggcactttaagaaggagcgcccaggcagcaagaaaaaaccattttgatcctgtccagcctgaggcagggaccactggagaacggactgcccccagagacagaggtcaccaggttcagaaccagtttcatagatggtccaacaggactgatgggtcttggggttcaaacccccagatccagtagcttaaactaccattacagcacaggagccctgagtgattctggaaattgaaggaaggaaggaaggtggacctccttctggacactggagccagattctctcttctcttctctgatctaggcttcccctcttcccatagcataactgtaagcatctcaggaaaggttctgacctgatatttttctcaacctcttagttgtagttggggggatctattatttatgcacaccttcttaatcatagctgaaagtcccacctctttactaggtagagacatttcagctcgcatggggatcaacatcctcatagccccaggacaaacacttttctccccctggtggaaggtaatatgaatccaggattgtgggcaactcaaggaagaatagattgagctgtaactgctaagccagttcagttccaccttaaggatcccacttcttttcctaaccagagacaatatctcctaaagccagaggctagcaaagggctagaagcccttattaataacctgaagatgaggggcttcctcaagccctctaacagcccttgcaataccccaatattaggagtgcaaaaacccaatggggaatggagactggttctagacctctgcctcattaatgaggccatagtcccaattcatccagtggtccctaatccctatatcttgctgactcaaatacctgaaggaactaaatggttctcagtcctagatttaaaggatgcctttttctgtataccattacatcctgactcacaatacctatttaccttcaaagatccctccagccaaactgcccagttaacatggatggtggtgcctcagggatttcgagacagtcctcacttgtttggacaggcattgtcaaaggacctttctgagttttcccatcctcaggttaggatcttgcaatatgtagataacatattgctctgtaccccaattgaggaagcttctcaggaaggcactgaagctcttctgaatttcttagccaagagagggcataaggtttcaaactccaaggcccagctttgccaaacctcagtgaagtacctgggtttagtgtgtctgaagggaccagagcattaggggaagaaaggattaatcccatttcctccttccccctcccccaaccctcaggcaactaagaggatttcagggcattagaggattttgcagaccatggatacctgggtacactgagatagctcgccctttatatcacctcataaaagaaacttaagtggctaaagctcatctcctgacctgggaacctgaagctcaaaaggcatttagccagctaaatcaagccttacgtaaggcacctgccctcagccttcccacagggagggccttcaatctttatgtatcagaaaggagggaatggccctgggagttttaatgcaagcctaaggaccagctcaatagccagtggactacctgagtaaggaacttgattttgtggctaaaggatggccagtatgcctctgagcagttgctgctgtggccctactggtatcagatgccaccaaatcaaccctggcaaattacttaactatttatacccccacataatgtagcagaattgctgtcttctaggggaagcctttagctaacagacagctggctctttaaatatcaagctctgctgttagaagggtctacaatccaattgaaaacttgtcctcacctaaacccaaccactttcctccccgaggaaactggggaacctgaacatgactgtgagcaagttgtggtacagacctatgcagccagggaggatctcagggacactcccctacaaaatccaggctggacccttttcatagatggaagttcctttgtagagcaaggagtctgtaaggcaggatatgcagtcatcactctgaatggtgtttttaaagtgcatccctctctccaggcacaagcactcaactagctgaactaatagctcttataagagcacttgaattaaggaagggaacagtagctaatatttacactgcctccaagaatgcttccttagttctctatgcttatgctgccatttggaaggaaaaacactttcttactgctaatggatctcctataaaatatcatcaggaaattaacaggttattatcatcggttttccttccacaaggggtagcagcgatgcattgtaagggacatcagaagggaacagatgaagtagctgaaggaaacatgttagctcatcagacagccaagtcagtggcaaggaagcctcagggcacaacacacttgaagccgcttgaatttgggaaggctccgtaagagaaatgaagcctcagtactcccctgcagagatagaatgggccacctctcgaaggtacactttccagccctcaggaccgttgaagtcagaggatggaaaactccccttgccagccttcagccattggaaagcccttaaaatccttcaccaagcttttcacttgggaaaggatataactgatctgtgtgcccagagatcgttttcaggagagaacttattaaaaacagtcaaataggttgttaatgcttgtgaagtctgtcttaaaaacaatcccctcaacaggcagctccttcctcctcaaacccaaaggatgggaagctatcaaggggaagactggcagatagacttcacccatataccaaagatgaagggcatccaatacctcctagtatgggtagatactttcactaactgggtagaggcatttccatgccgtacagaaaaggcctctgaagtaataaaagggtgagttaacgaaataactcctcactctggtgtgcctaagtacctcaaaagtgacaatggcccctcatttaaggcagccatcacacaggcgttctcaaaggcactaggcatatggtatcatctccattgtgcttggagaccccagtcctcaggaaaggtagagatgaccaacgatgttatcaagacacatcagaaaactgtctcaagaaactcaccttccttgggtcactcttctttccatggctttactgcgggtaggaaataccccttcaaagttaggtctgagcccttttgaaatgctgtatggatggcctttccttaccagtgatttcttattagaccaggagacctctgaattggttaaggatgtaacttctctagctcattttcttttttttttttttgagacagagtctcactctgtcacccaggctggagtgcagtggcgcgacctcggctcactgcaagctctgcctcccggcttcacgtcattctcctgcctcagcctcctgagtagctgagactacaggcgcccgccaccatgcctggctaatttttttttgtatttttagtacagacggggtttcactgcgttagccaggatggtctcgatctcctgacctcgagatccgcccgcctcggcctcccaaagtgctgggattataggcgtgagccaccacgcccggcctctagctcactttcaacagcaatgaacacaactggcaaaagcccagccctcaaaaacaggagcacctctatttaacccagaggatttcgtcttggtgaaagctctcccttctctccctcctcccccacgcccaagctgggaagggccctattctgttcttcttatatttatttttatttttatttttttttgagacagagtttctctttggttgcccaggctggagtgcagtggcgtgatattggctcatcgcaacctccacctcccgggttcaagcgattctcctgactcagtctctggagtagctgggattacaggcatgtaccaccatgcctggctaattttgtatttttagtagagacagggtttctccatgttgatcaggctggtctcaaactcctgacctcaggtgatccacgtgcctcagcctcccaaagtgctgcgattacaagcgtaagccaccgcgcccagcctctacactgttcttcttttaaccccctcagcagtacaagttataggtattgactcctggatacatcacactcaagtcaaagcatgtaaagctaagaggcaacccctgacagcccagaggaacgtcctggatataaatgtgaagaaatagaagatgttaagctgaaaatcataacagataagtaaatgagtgagggcttctctacctactcagtcacacccctaccttaccatataccttcagtcatttctacttttcctctcgagatttgccatcaaatattaaaacatctttttgaaatgtactttcagagagattttgattatccaggggattacatttgtaacttcacagacccccagagggaaagtctatatcttggtgagtaaaattttagatggaaattatctactatacctcccttgcaggaattgttgtgctcactctacttgtagtaggactgtatactgtcacacccccagaatggaatattggatgaagaatctcaatcactgaagtattttgcttaattattatccttacagcagggacaatagttactgacgacaggtaaacatgaaggttttactatcactgagtcagctaggactttttctttttcttttttactttttttttctgagatggagtctcgctgtgtcgccaggctggagtgcagtggcacacaatcttggctcactgcaacctccgcctcccgggttcaagcaagtctcctgcctcagcctcccaagtagctgggactacaggcatgccccaccacgcctggctaatttttgtgtttttagtagagatgaggtttcaccatgttggccaggatggtctagatctcttgacctcgtgatctggccgcctcgctctcccagagtgctgggattacaggcgtgagccaccgtgcccggcctacctgtgcacttttaaatgaaacatgctgcttctggatcagcatctctagtcaagtagaagagaacctacaggtgcttaaagaccaaattagaatcattgacaagttaagagaaaacgtggattccagtcttctttatggaattgattagttccttttttaagcccgctcttgctcgtgtgttttgtactaatatttggaccttgtatacgcaatacggtaacttgaattatttcctctcacctagaagctattaaactccaaatggcgccgcggatggaacctcgcatggacatgccattcttccaaggacccttagatcgactccaggaggagctctagctgctgtgccccactcaatgcccctctcttcagcaggaagtagccagaaagtcattgcccaataccccctaacaggagttagggttaccactcctgagaggggaaatatgatacaggagctagaaagaaattatttggcagacagtgagggtgaataagtcctcagcaaggtttcccttttaagaaaacgcagcccccaaatcatttcttttctaacaaagagcagcctgaaaaattgagctgcaaacataggtaagcaagttggaagcttgcacggggggatgccggcacctgtgctgatagaagaaagctaccgggggccaggcatgttcaacatggaggctccatcttcccttttgtcaccatgtgtacagtaaaaaaagcaggcaacatggcaccggccaggtagagaatccatctgaataataaaagattagggtggggcggccagcttctttgtgcactatgcaaacagcacacctagtcctaaccagttctttgaatgctatgtaaacggcacaccttgtccaaccaatctttcattccctatgtaaattagacaccacctcctcaagcacatctataaaacctcctgcacttcactgcagaccagaagacctgcttgggacctcctctctcttcaggagagagcttttctctttctttcacctattaaacctccatttttaacctctctccttgtgtgtctgtccttgatttccttggcatgggacaaggaaccttgggttttaccccagatgaacgatgccacttcaccactatgttgcccaggctggtctccaactcctgggctcaagcaatgttcccgccttggcttcctgaattgttgggattacaggcgtaaaccgctgttcccagtctgaaaaattttcttcagagagaacaggctttgtcagtggtctacttgaacagtatactaaattcatcaggtttggggatccaaaggaactgtccattatcctcatccatcagcaaaaagaataggccctttggtaaattatttttgtaagtgcttaatcctcaattacttgttgctgggccttgtcatcaccaggaatcattccgtgctttgtgtccttaatgccagcattcacgatttaaaactaagctttctagcacttgcttcactgtttcaaccactttcttcctgggactttcaaattctttgactcctgtgttagttcaagtctacagaaaagtagatgtcaaggactacatgtgaaagaggtttattagagaaggaacagaaggcaggacaaatcttcagactgattgcaggtctgactatggaaggagagagggaaggaaggagggttgggtaggactggactgtagcaaaattcagccaggccacagggagtctttgagccaaaattgcctgttggaggtctgtatgtcaacagaatgggcattcccttaacgcacctcttttattaatctaatcatccgcagtccccattactctagtcctactgttgaaaatcatacaatagtagagaatactgaagccactgttaaaggccctccatagtatcccttcttaattccgattgtccacagcagttaccacgactcctcgtccttctcagctcctcttctattctgtctcaagtaacactgcttgtgttttctgagagaatatggcacctgtaggtcattaatttatctaaaaagaacacgtgtagtcaatttctttcatctaagctaagagcaaaatgtgctttaccagtcttaggaccccatcccttttcctacaaccatgttgatccctctgagctgtatttaaaaatactcctcagctgacttcattcttacactctagttccttttttttttttttttgagacagtctcactctgttacccaggctggagtgcagtggcacgatcactgctcactgcaacttccgcctcctggcatcaagcgaccctcctgcctcaaccttccaagtagctgggattacaggcatgcaccaccatgcctgggtaattttttgtatttttagtaaagatggggtttcgccgtgttggacaggctggtctcgaacttctgacctcaggtgatctgcccgcctcggcctcccaaagtgctggggttacaggcgcgcgccaccatgcctggcccaccctaggaactttttttttgtttgatgggtcttgctttgttacccaggctgcaatgcagggggttcttcacaggtacaataaataatagctccctgcagcctcgaactcttgggctgaagtgatcctctcacctcagcctccgaagttgctgggactacaggaacctgccaccatgcccagctgttttataaaatatttttagaaatgggggtttcaccatgttgcccccaggctagacccatgggctcagttgtcctccctcctccacctcctgagtagctgggactacaggtgcacaccaccattcctggcaagaaaacattcttttttttttttttttttttccgagactgagtcttgctctgtcacccaggctggagtgcagtggtatgatctcggctcactgcaacctctgcctcccaggtccaagcgattctcctgcctcagcctccagagtaactgggattacaggtgcccaccaccacaccaggctaatttttgtacttttagtagagatggggtttcaccgtgttggccaggctggtctcgaactcctgacttcgtgatccgcccgccttggcctcccaaagtgctgggattacaggcgtgagccgctgtgcctggccaagaaaatattcttaattccatttaggttcacataaattccatttaggttcatatccaacttcagatgaattttcttgatagaacaaatgtgcagacttttcagtaatacagactgaattattcaccaaaactatattgacgctacatgacagaactaaaaaggagtaaattagggtcagtttaatgtttcattaggtatttagagaccaaaagaaaccacaaaatcttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactagagcctgcgcatgcgaacagcggagccttcctgcttttctccctcacttccgcttccgcctcggctcagccgcccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattc

SEQ ID NO: 375 - DNA, 8565 bp, Homo sapiens
ttcttaccaggattctgcaggagaactgtgaaataccatgatggttttctctatcagtagggagcttgctgtcctctctgcatctgaccttctttctctaggagttcttagtttctgtagctttcactattctcctccttctcctcctccttctcctccttgtcctcctccttgtcatcctccttctcctcctcctcgtcatcctccttctcctcctcctcttcatcctcctcctccttctcctcctcttcctactcatcctcctcctcttcctccttctcctcatcctctttctcttcctcctcctcatcctcctcctgctcctgctcctccgccttctcctcatcctacttctcctcttcatcctcctcctgctcctgctcctccgccttctcctcatcctacttctcctcttcatcctccttctcctcttcctcctcttcatcctcctcctcctgctcctgcttctccgccttctcctcatcctccttctcctgctcctcctcctcctgctcctctgccttctcttcatcctccttctccttctcctttcttcttctttgagacaggatcttgatctgtcactcaggctggagagcagtggcgcgatcatggcttactgcaccctcaacctcccaggctaagccatcctcccacctcagcctctcaagtagctacagatgcatgctatgctcggctaatttttatatgttttgtagagatggggtttcgccatgttgcccaggctggtctcaaattcgaaggcttaagtgatcttcccacctcggcttcccaaagtgctgggattacaggcatacaccactgcgcttggcctcacttatttccttccttcctccttccttccttctttccttccttcctttcctttccttttctttccttccttcctttctttccttccctttctttctctctctctttctctctctgtccctccctcccttccttccttcttttcttccttccttcctccctctcttttctttctttctctatctccttccctccctccctctctccctccccccaacccttccttcctcccttctgagacaaggtctcactctgttgcctccgctgaagtatagtagcttgatcttggctcactgcagcctcaacctcccagtgtcaagtgattctcctgcctcagcctcctgagtagctgggactgcaggtataaacacacctggctaatttttttttttttttctgtagagatggggtttcaccatgttgcccaggctggtgttgaactcctgggctcaagcaatctgctcaccttggcctcccaaagtgctgggatttcaggcttgagctaccacgcccagcctcacttttttttctttttttttaaatggcagctttattgagctgtaatccacatatcataccgttcacttacttaaggtatacaattcagtgcttcttggtgtactcacagaattgtgaaatcatttccacaattcattttcaaatattgtcatcactccaacaagaaactctgtacatgcttagcactgcttttcgttttcccagccctaggccaccattcatgtacctgctgtctctgggtttgcctgttttgcacacttcacataagtggagccatgcactctatggtcttttcttcttcttcttctttatttttttattttttgagacggagttttgctctcgttgcccaggctggagtcaatggcgcgacctcagttcaccacaacctccgcctcccgggttcaagcgattctcctgcatcagcctgtcaagtagctgggattacaggcatgcgccaccacgccaggctaattttgtatttttagtagagacggggtttctccatgttggtcaggctggtctcgaactcccgacctcagctgatctgcctgcctcggcctccccaaatgctgggattacaagcgtgagctagcgcgcccagcccgtttctactttaatttttttttttttttttttagacagggtctcgctctattgcccaagctggagtgcagtggcatgttcatggctgactgcagcctgggcctcctgtactcaagtgatcctcccatttcagcctccccagtagctgggactacaggtgcttgcccctactactggctaaatttttatttttatttattttattattattattattattatttttgagacagagtctcactctgtcgcctaggctgcagtgcattgcaacctctgcctcccaggttcaagcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctggcacctggagatctggcttcagggacggcaggattcaggagaaaaccccactgtccgccactcagcctctgctgctatttattgctaggcctgaagtttaacagatatttatgggagcgccccgacctgggtgccaacctcacctcctcccttctcttcctccacatagctcgttggtcccaggccccttgccctcctgcccccgactttttctttctttcctttttttttctttctttctttctctttctttctttttctttctttctttctttctttctttctttctttctttctttctttctttctttctctctctttcttttctttctttctcttttcttttcctttcttttctttttctttttctcttttctttctctctctctccctctgtcctctgcccctctgcctccctccctccttccttccttccttccttccttccttccttccttccttctatgcttccttccatccctccaagctaagggtttaacccttgccctgcctgcattatggagtatcctgcattaggatactcctccttttgaggagagcaaacagaaaagtttgtggatacaacctggtgactggttttttgtttgtttgtttgtttttgttttctttcttttcttttttttttttgagccagagttccgctgtgtcgcccagactggagtgcagtggtacgatcttggctcactgcaacctccacctcctgggttcaagcgattctcttgcctcagcctcgtgagtagctgggattacaggcatgcaccactacacctagctaaattttttttgtattttttttgtagagatggggctttgccatattgaccaggctggtcttgaactcttggcctcaagtgatccactggccttagcctctgaaagtgctgagattacagatgtgggtcaccgtgcctggccaacaacctggtgactgtttacaagggacctgacacatcctgaatggttgacagtgatgacagtgatgatccctactcaagcttttcccagtagacacgctgagaggcaggcttcctctaagctatgttagcagtgttacaaagtgattcaacataaataatttattcaagcagggagcaagatatgagagttttgcagaacactaatacttctgtttgtaatttgttgtattttgtataaagtgacttttgagatgaaagggctaaggccatatgctaccatgctctaggattgccagtgatattttggacagtttatcaagcctaccactttccaggtgaaaaatggaaagatctcagcttaaaagggagaaacgggcctggcgtggtggctcatgcctgtaatcccagcactttgggaggccgaggcgggtggatcacctgagatcaggagtttgagaccagcctgcccaacatggtgaaaccccatctctactaaaaatacaaaaaattagccgggcatggtggcaggcgcctgtaatcccagctactcgggaggctgaggcaggataattgcctgaacctgggaggcggaggttgcagtgagccaagatcatgccactgcactctagcctgggtgaaaagagcaaaactctgtcaaaaaaaaaaaaaaaaaaaaaagggagaaatgtctaatcatctccggaattgaatggatgaatcatcctttgtttcgccagttccctctagatggacatttaggttctctctttctttctttttttgttttaaatagagacagggtctcactctgttgcccaggctggtctcaaactccagggctcaagcaatcctcccaccttggcctctcaaagtgctgggattacaggcgtgagctactatgctcagccttctgtttttttattattccaaaataataaaagtttacatcccagatgtaaagtttatgggtcaaagggtacatttatttttgacatggatagatttccttctaagtagcttcactcatttccacacctgccatcagggtaagagagtgcccccttgaggccatgctcgacaatgcctgatactttcactctaaaatgtagctctcaatttaactgaaaaaaaatttgccaatttaatgggtaaacatgacctctccttgttataatttatgcactcttgactaccagataggttggacatcttttcctaagcttaatggccatatgtccttgtgcccccttgttttttttttggtttttgtttttgtttttgtttttgagacggagtctcgctctgtagcccaggctggagtgcagtggcgcgatctcggctcactgcaacctccgcctcccgggttcacgccattctcctgcctcagcctactgagtagctgggactacaggtgcctgcctccacgcccggctaattttttgtattttgtagtagagacggggtttcaccgtgttagccaagatgttctcgatctcctgaccccgtgatccgcccgcctcggcctcccaaagtgctaggattacaggcgtgagccactgcgaccggccaccctcccgtttttttaattggggttcattgatttgtatatgtataaatgtatatactccttatactctggatcctaatcctcggtagttttgttggtcttaatatcttcatatcttctcgaagtctgtggcttgtcttttcactttcacttttgtatgtttcttttcttttcttttttttgagcctgcctcggcctcccaaagtgctgggattacaggcgtgagccaccgcgtctgtccatacactaggtttttaatccatccaaagtttaagtacatgaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaaatatctgtctctctgagtctctgtctccctctttctctggatctctgagtgataccctatattccccatcatcatctctctgggtctctgcctaccccaccccctctgtctttctgtctgtctttcttttttctttttttttttctttttttttgagatggatgttagaaatgtttattttgtggtgtcgtaaagaaatagtacttgaacataaatttaatttttttagtaaagccatttttattttttgtagaaagggtacactcgccagcagttttgtcatgagagtacacggaacaaaggagatagggtcatttataacctgacgcgtctattttactgctgtgtctggtttttattggctggaaccggactttacattttgtatttgtcttgattggctagtaacttagaagtttttaaaagaagcgaaggcagaggagaacaaaggaaggaggaagtaacttgtggaatgttgagaaaggtaaaaacacttttaaataaggaagaggaacaggctatgatctaatgcttgcttgaaccagtataagtatgtcagggcaaatatttaggctaaattgtgagagctaagaacataaagtacattgatttattttttatggctagtagatatttaagaatgttagcacaggtgtttgaataaattttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctcccca

SEQ ID NO: 376 - DNA, 15186 bp, Homo sapiens
gacacaccagattttatgtgtttgatcactactttttgaaggaccattattaaggtgtctttcagaaagtagcatctgaatgtcttgaagacttaatcattaataccaagatagatatttttagcagtaaataagagttttattatttttgattagcttaagggagtccttctgtagttaaataaggcacagctaggggtttttttttgtattgtacaccttactactggttttcagacttccaagtgaatttacttaggcttaacttacatatatttagctaatatctgtaataaatatgttcctggcagatagtactatataagtatttactattactattttatgagaaaacagggtcaaagagtagtttaaatgttgggatatttaaatttttaaaatccttcatgtggaaaatacatacattttatcctgaatttaaatgcaaaatcagtttagaaactggtcaacacgtgtcaattttttttttaacacctagcatttatttagtgccattcattcattttcatggtttttttttttgctttttttttttttttccttgagatggggtcttgctctgtcaccccggctggagtgcagtggtatgatcatagctcactgtaacctcaacttcctgggttcaagtgatcctcccacctcaggctcctgagtagcgaaaattgtaggcgtgcaccatcatgcccagcaaataaaaaaaaaaatttttttttttttttgtagagatggggtcttgccgtgttgcctaggctgatcttgaacttctgacctcaagcagtccttccacctcagccttccaaagtgctgggattacaggtgtgagccactgtgcccaacctgttattttgctttttgttttgaagtgtttctttgcatattttgcctattctcttctcttgataaacctgcaaaaaaggcaagactagtatgattattctcttattatatttaagaaggaaactaaaacataatatgatggccagcatgatccaagtaaacttttttttgggggaaataaaactgtttctttagcgtgaaggcagaatataaattggtagaagctagtaaatggtacttgattcaaaatgagaattttagtgatttatatatgccatgtcattttgtaaaaatggtttaatgatttaatccttttttttttttttttccaactagatggagttaccatgtggattgacaaaccttggtaacacttgttacatgaatgccacagttcagtgtattcgttctgtgcctgaactcaaagatgcccttaaaaggtaagactgcagtcttttttgggtaagggatgttcacatttggatgagtagtattgttttgttttgctttctttagcatcttaattgagatataattaatttattatacaattcagcattttaaagtgtttaatgctttttatagtatttacaagtttgtgcaaccatcaccaccatcgattttaggacattttccgccccctccaaaagcagtgtcgtactcactggcagtcactcctttaaccccttcacccacctctagccctagccaaccgttcatctactttctgtcatagatttgctcattctgggcatttcatgtaaattgaatcgtataatatgtggcctttttgcggctaacttctttcatttggcatgttcccatggttcattcaggttacagcacacgtaacacctcattcctattttatggctgaatagtatttcatggttcactcacgttacagcacacgtaacacctcattcctattttatggctgaatagtatttcatggttcattcacgttacagcacacgtaacacctcattcctattttatggctgaatagtatttcatggttcactcacgttacagcacacgtaacacctcattcctattttatggctgaatagtatttcatggttcattcatgttacagcacacgtaacacctcattcctattttatggctgaatagtatttcatggttcattcatgttacagcacacgtaacacctcattcctattttatggctgaatagtatttcattttatggatatatcacattttatttatccattcattttgttgatggaaatttgaattgtttctcctttttggctgttatgagtaatgctgcagtgaacattcatgttttttgtgtagatgaacgttttcatatagtaactctatgtttaatgttttgaggaactgccacaatgattttccaaagtgacggtaccattttacattctcaccagcaatgtgagaaaattgccaatattgtctgtctttgattaagccatctagcgctatgaagtgtggtatctcattgtggttgtcatgcacattttttttagtggctaatgatgttgggcatcttttcatgtgcttattggccatttgtatatcttctttggagaaatgtctgtttaaatcttttgcctgtgttttaattgggttatttgtctgtttaaaaattcaattgtgtttttacatatatacaagttccttacccaatggataatttgcaaatcttttcttctatactataagctgtcattttactttcttttttaaaatttatttttttcctaagtctgttgtatgcagtctccttttacttttcttgatggtacgtttgtaatgcaaatgttttttaattttgatgtagtttaatcttaattttaattttttcttttatcacatatgcttttggtttcatatgtaaaagccattgtctaattctaggttacaaagacttacttctttgttgtttttcaagagttaatatacttttagctcttctattcaggcctgtggttaatttttatgtatggtgggagggagggaggtatttgcctattattttgcatgtgtatatccagttcttccagtatcatttgttgaaggctattgtttccccactgaattgtcttagcaccttttttgaaagtcagttgaccttaatgtataggttcatttctggaccctggattcttttccatttatatatatgtctatccttatgtcagtcagtactggtttcaaaaaagaaagaacattttgtttttataccatcgtatgaaaggaaaagagtaaagaattaattacaaatgttttgagaacctgtaaaatggtctacaaataagggccctttcttccggtgagtataagtgtaacttaaaaaatatgtaacttaattctgactaaatttatacaactgtcttgatacataaattgtcagttctttatgatagaattctgaactacaatttggattctagacagctttatgaatattgatttttgttttttcccctcagtctattgtgaaatgttgtgatagaactgagcagaagagaagggagagaaggagtgtgcaaaaatctgaaagagtgactttaaaggttttctacatttctctgaagcgaatagttgtcaggtatttatgagaaattgcatagattgcagctgatatattatcagtgaacaagacacagtatctgtcttcaaggcacctacagtctaatagagaaagactatcaagtaaacaggtactgtttcagaactgctttgatgggaaatgtaggctgctatgagaacatctaagggagttcatcaggggtatctgaggatagtttgggaagacttcttagagtaactggtatttaaacagttaggtgttatcccagcctggatgagaggttagggaagtgtgagagtggactggaggaaagagtttttaagcaacagtctggaggcaggagactgcaacatactcagtgcaactgcctggagaaggatggatgtagaaacggtgatagatgggagattagcaggggccagccagaaatcttgaagtcgtttttaagaagtgtggacttcgtgttgtgggcgaagagaaaccattggaagattttaagcagagtactgacattcaaattatcctctgaattctaggtagctaagattattattttattcttcaacagtttttattttaattttgcttaaaaaattgcctggtgaatcttactgtgtcttttatatatatcccaaaatattgctttattttaccctttcctcttatccttggatgataatattgcttggagcaagagtctaggtcaaagccatttttcctcagtgattggtagttatttgtccactatttttgtgtgtccatgcttactgatgagaggtctgatatcagtcttgatttttattcttttctgttagtagcttttagggttttctcttttttttttttctttcccccagttttccaagaatgtgagactgtgggttttatttatcttataaaagtactcagtgagcacttttagtctgaggactcttgtcgcaaactctaggacatttcttggtcattatttctttaggtactgcttctcctccacctggtttcttatacatattaaaatttctagatctgttttttagtcttctaactttcctccgtgttttaaatttttataatttttatgtgatgtgctctaggaaaatgcctcagttctgtcttacattttactgattcatacgtctactttgtttcactgcttacttatcatgaccttctgttcttttttataactccttattcttaatttttggatctaaatcctgcttttatttttctgaggctctgaagtatttttatttaaaggttttttttttttttccttgttgtttggccttttaactctgttctttttggatgtaagggttgttcttccctcatttgtttaaaggttgtgtgctcatatcatgcaaccatattctcttccttatgtcccagttgcaaattatctgaataggtagtttgctggggtagctttctggctagcacccttgggagtggctgatggagatagccttggctcacttccaagatttcctctttactgttttcttcttggatgccttttagcctctgttcctgagagagtgctcttttatgttttggaaagagttctgtgtaagcaggggagatttcatcctatgtggttctattttcctgaaaccaaaagaagtattttttgtttttcctttttttaaaaaaataaaagtgaaagttacttttttcgctttttggtttttatttttagtattttttcttttttttgtacagcaacctctgatgccaaacaaaagaagtagtttttgaattctaaattttctcaagagagtgcacttactaacgtaattgatacaagatgtcatggatggtggtatgtctttggaaaaatggcactaactgataaaacaagaatgaaagaacagaaaaacattccacgagaggtgttttacagctggagatgaggaagaccatcctcacaaatacttagcagaacttgtctttggcaggttctatagagtgggaggtatgggtcccgagtgtgatggctcacgcctgtaatcccagtactttgggaggccgaggcaggtatctcacttgagcttaggaatttgagactagcctcggcaacgtggcaaaaccccacctctacaaaacagacaaacaaacaaaaaaccaaaaattagccaggcatggtggtgtgtgcctgtagtcccagctactcagaggctgaggtgggagattgcttgagcctgggaggtcgagtctgcagtgagccatcagtgtgccactgcactccaggctgggtaatagagtgaggccctgtctcaaaaaataaaataaaataaaaagagagtgggatgtataatgatggagggtagaaggaaagtgtgttcaagagaaatagactggattagcttaagaggcagtaaggatcaagaactatagccacaggtgaaaataaggtttgaaatggcttgcttaatgccgcccaacagtggaatcccatcatactcctggagttagattctcaatttagaacctagagtgaaaactatatgttataaaaaaatcatcctaaaattctataaattactcctcaaaagacagtatcacatggccgtatctgttgtattggagactggcaagccccagctctcaatatacacagcgttaacagttactaggttgctgattttctttcattttttttttcttattttttatttatttattttcgagacagagtctcactccctcacccaggctgcagtgcagtggtgcgatctcagctcactgcagcctctgcctcccggcttgagcaattcttctgtctcagcctcccaagtagctggaattacaggtgtgtgccaccatgcctgactaatttttgtatttttagtagagacgggttttgctatattgtcaaggctggtttcaaaatcctcacaagtcatctgcccgcctcagcctcccaaagtgctgggattacaggtgtgagccactgtgcctggctgaaaatatttgtctgttaacactagcgtctcattcagttcagtgagatgctcatattatgagaggcatgcaagaactgagacactcggagagaacagaaaagccccatatctcatctcacagctgtctaggggatatgttcattgagtggaattgcatgtgggattgcttacactacttaaattattttcttttttttagctttttgagggcatgtcttcatttaaaatttaaaaaaattttaaattattttttattttttgagacaggccctcgctctgttgcccaggctctggagtggcacgatcacagatcactgcagccttgacctcttgggctcaaggatcctcctgacttggcttcccgagcagctgggacctcaggcatgcaccactatgcccagctgattttttttttttttttttttaagtagagacaagagatggctatgttgctcaggctggtttcaaactcctggcctcaatcaatcctcccagctcagtctgccaaaatactgggattacaggtgtgagccaccacatctggcacacatatcttcattctaagtaacagatttcaacttgttcttgacaaaaaaattttaaataacagaaaagtctacatatttgatattcactttttctcagccatcttctcggcccttatgtcaggatatgatgaaaatgcatcatacatttaattcatacagattgaagatgtgccctgggctggatgtgatggctcatgcctgtgatcccagtgctttgggaggctgaatctatagcttgaggccagaagtttaagaccagcctgggcaacatagtgagacccgcatctctgcaataaaaaagaaatagctgagtgtggtggtgtgcacctgtagttccagctactcatgaggctgagctgggaggaatgcttgagctcaggagtttgcaactgcagtgagctgtgatgatgccactgcactccagcctgggcaatgcaatgagaccctgcctcttaaaaaaagagatgggccaggagcagtggctcatgcttgtaatcccagcactttgggaggctgaggcgggcagatcaccgaaggtcaggagttcaagaccagcttggctaacatggtgaaaccccgtctctattaaaaatacaaaaattagccaggtttggtggcaggcgcctataatcccagctactcgggaggctgaggcaggtgggtcgcttgaacccgggagcagaggctgcagtgagccgagattgcaccactgcactccagcctgggtgacagagggagactgtgtctcaaaaaaaaaagagaaagggatgaagatttgcgttatatttgggttttttctttaaacatatgtgtagcagtgtatgtgtttttttataaccaattcaaacagtcttaaatttgtgctcatgtctttgtttttatgcttacatattaacaattctgcagtacatcttgatgcataggattctttggatcaatttctggaagtggagttagtgggttaataaattagagtggatagtttgacctttcagatattggcagttgttatcccaaaaggtagaaaaatatgaatgctacattctgtacatattcatcaatgtaaaatattataatgataaatattttttgactactggtaagattgaactactgtttactcgtgagtttattggtgacttacatttctaaggtaaaaatctaggtttctcttttttctcccatcaccatttattgtatattgatacacattgatcttttatcatatgtattattattaaatatttttgagacctgttcctagattttctaactgggtttatttattgaggtctgattttcgatatgtgtttgtattatgccattttaaccatctggtgtgtagtaatgcatacttcttactttcagtgtattactggatagtttgatccatattttacatatctttgaacttcatagtcatgttcaatacgcctttctccctctaaatggatatatagtgggagtgtcagcctttgggattttgaccataatggctttaagtttgggataaattgacatttttgcaatatttagcttccccatccaggaatataggctgtctccccattgtttcaggtcttatttgactttcagtaagatggatttttttcacgtgttttatttccaactgttttgaatttttgtattttgtaatgttagatgaattttcccttgatcattttgttattggccctgctagctgatgggaagaaatcaggagtactaatttcaaatatcagatttccatggttccaagatatactttcccctaatattgaaatagtccttatattctatgaaaattttaatgtagtttttatttaccttgaaaacacatttatttaccctgaaaacacattttagttatgatgatatttatgattatgatttatgatatatttatgaggaaataaggcatattttctattagtatttggattttctaaatagataatcaaatccattactcaggttatttttgtctgtttcaggtagtttacttcatgtttctttcgtgcttcactggctagaacttttaacacaatgttaaatagtagatggttgtggaattctctcttgtttttgattttaataggactgttgtattttagggttaaatattgatcttgggtttggtggaaatgttctttttttcttttttctttttttctccttgtcttcttcccctcaggtttggtggaaatattcttaagaatgttaagaaagtatccctccatttgtttactggaggttttttaaaaataagaaatacatgttaaaattatcaaatgttgtttgttgacctagtactaagatttttctcactggatctatttgtgatacattatgttaatagttagcctaatagtagactatattcctgatacattcgtattctttcaatatatagcgctgaatttaatttgctggaacattttaaaaggattttttggggtcatttgttagtaagactgatttatagcattctgtctccctctggcttttttttttttttttttcctttgtgagggtttggtgttacagttatgctagctctatgtctatcttttcctggaacttttattttctttcatgtttttataggactgatctgttgttgaaagccttgcccatgaaattgtctgcactcagcttttttggggtattttattttattttattttattttgagacagagtctcgctgtgttgcccaggctggagtgcagtggcatgatctcggctcactgcaacctccgcctcctgggttcgagcgattctcctgcctcagcctcccaagtagctgggattacaggcacccgccactatgcccagctaattttttgtatttttagtagagacgtggtttcaccatgttggccaggatggtcttgaactcctgacctcaggtgatcccccggctttggcctcccaaagtgctgggattacaggcgtgagccaccgtgcttggcctttggggtattttaaatgtacttattctcttctaaagtcagttttggtaatttatattttcctacaaaattgtcctgtctttaaattatttcagcttaagagttattctactattggacctgtatggttttttttttgtatttttatttcttatttgttatatttgtgttttcctcccttgattttcttgctagagatttgtattttagttttcaaagaattggctattagatttgttcattcaattttttgagttgtctgattcatcctacttttgtttgtattaattttttcttatttctgtttaccttaggcttgttttattgtctattttctaacttaaaagtttcatatgtggattgtttacttacccttgtgtagtaatgaaagcatttagttctgagattttgcttgttctctatttgttagatgaggctgttcaaatgttgacaaaagccactagaaagtctcttatcttttccttttagctcagttttgtttgttttttctttgttttttttttgagaaggagtctcactctgcctccagactggagtgcagtggcacaatctcggctcactgcagcctccgcctcctgggttcaagtgattctcctaccacagcctcctgagtagctgggactacaggcgcgtgtcacaacgcccagctagtttttgtatttttattagagacagggtttcatcatgttggccaggatggtctcgatctcttgacctcgtgatccacctgcctcggcctcccaagtgctgggattacaggcaagagccaccatgcctggcgcgtttatttttgattatggaagtataacatgccagagtatacaaattataagtgtacaactcaatgaattgtcccagggtgaacacatccatatacccaaaataaaggcagaacccttctagcactctaaaaatcccctcacagatcttaatcactaacaccgtttatgtttcccaaattggaaatactatcctgacttctaatctcatagatcaattttaccagttttgaactctatgaacagaaatgtacaaattgggcccatttgtctggctgatgactgggtaatgggtctggctcatgatgtttagtgtatccatgttctgtgtattggtggttcgtttatattcatgctatatagtatagtattccgttgtgtcctgtactaccaagttattatccattcttctgttgatgaatatttggtttatgttcagtttttggtgattatgaaaaaatatactctgaatattctagtacatttttgggcacatgcatttgtttctgttgggtatatatgagtatgtatgcatatgcacaaaatatatatgagtgaaactgctgggtcataaaaggatttatatattcagttttagtatgttttgccaaccagtttcaaaaacggaggtaccaattcatattttcattagcattatatgtgctttccatctgttccacatccacccccaagagtttaagccaagttatttagccagtggatttagaaacacatatatgaaagcatatgttataaatgtactttatttcactatgggtaaggattgtggcctacataacttttggtttttggaaatttgagtttgtctttttgatctgatgtatgattgaatatttcatagggactagaaaagtcaaaatgtcctctctttgtaggtgtcaaagtataatagacattaggttaattttattatgttctgattttctatatcattactttttatttattgacttgacagagataaggaaagattctcagtacttttgactgtaaaacctctcagtatttctgtcagtttccttttattttctaagtttttctttataaacttcagtgttaatgttatttggcttaatggatggttttacatgaattaggaattacattttattgctctaatatgggaatttttttttggatattaaattacatatgaccttccttagttacaaaaaaaaggttgataattcattagtatatctttgccataaatgtagaaatagttacatattcatgttaccctataacaagaagtaaaattcagtaacagcagcgattatatagctaattacatacccaagtgatgttcagggtatgtctgctatattagtacttaattttaatttcaaaaatgccttttaagaagttgctaaaatgtcttaacagggaaatgtaatgattttcaggtttttaaaaatgaacacacataattcaggcattattgtgaattattgtgtattgaaaaattaagaaaattcgttgagtcacatcagtttccgaaagatgcaaacaaatgaaaaagggaaaaacaaaatccttcaattgagtacaatttaacacaatactctctgtgatttctttcatactacttaacataagcatagaggttttgctttttaaattgagatataattcacatctagtgaaatgcatatatcttaagtgtttggtttgatcagttttgacaaatgcaaattctctgtaatccatttgcctatcaaagtatagaacatttctatcatctcagaaaatttcttgggcatgccttttctcagttaatccttatcctctccacccccttccagcaactactgatttcatattagtttgcacattctgaaacgtaaaataaacggaatcctacaggtcatgcttttcttttgttctggcttgtttcactcagtatctagcttggagatccattcatattattactgactagatcagtaattctgattgctccacaatcttgccgatattgggtgatactagttttttttaaattttgattttagtcactctaatgggtgtgtagtatgtacacatagtttaatcatagtgtatatgcagtctccctctcacttcagtgtttgatattaactgaatgataatttctgagcttttgtaataagacattgtgtgagtaatgactatggtttgaatagtcatttgaaaaggaatttgcatggccagtttgttgtactgttgtaaattaagtgaggatcataaagctgaaagtgaatttagaaatcatttaatagaagcttctcagtttacagatgagcaaactgacctacaaccttaagtgacctatttaatgatacacagcaagctaatgctgaatgtaggtgtatgatttttgattgaatgtttttgatctaatgcttatttcttccaagttatttcagagattgtgttattttattttctttgtaattaatgaatagtgttgtttcacaatactttcagaaaatgtttgttttagctgggtacagtggctcatgcctgtaatcccagcactttgggaggccgatgtgggtggatcacctgaggtcaggagtttgagaccagcctgcccaacatggtgaaaccctgtctctactagaaatacaaaaattagctgggcatgatggtggacgcctgtaatcccagctgcttgggaggctgaggcaggagaaattgcttgaacccaggaggtagaggttgcagtgagtcaagatcatgccattgcactccaacctgggcgacaagagcaaaactctgtctcagaaaataaaaaataaaataaaatgttcgttttatatgagtttgacaaagggaaagagcttaaagtaggctccatctaaattcccttttcagcattcctttttttctccatatttctggtcatgcaagaccagaagagaagaaaaggaaaggtgggaacaactctgagaaacttgcagttgagggtgtcataagaactccttttaactggtttcttcccatttgagtgttagaatgaattgaattctattgtttaactcggctttaatgttcctaggtatgcaggtgccttgagagcttcaggggaaatggcttcagcgcagtatattactgcaggtttgtatactaaatatactactttttgataggagtaagacattctatttttcgctcacaatcctttgcagtttacagaatgtcttttgtaaaacatcacctcattaagcctggagtgtacattatacttaagttaaacaacttggtacttattttatcgtccagattataaatcaatgatgtctgtcgtttgtgaaaaataatctttggatttttttggattaaattataattttggcttcaggtttgatttgtataatacatatctttggggttgactctggggatagccagcgacgggttttatcataatccatgtatcattataaaagagggtcttagtgaatattggtgtaaagaagtgatgtgtgtgaggagaaatagtaatcttaaaggatagaaataactggtttcttcattgcataagagaatataacccccacctaattttggacattttaatactgttaaatctttgggttaggtcaatagggttttacagccatgcctttttttttactctctctctaacagctttattgatatagtgtacatatcataaaatctgcccatttaaagtgtataattcattgttttttagtttatccacagagttgtgcaaatattactaaaatgttaattttagaacattatcattccaaaaagcaacttcataacatctagcagtcacctcctttcccatttctagccctacccatttatctatgtgttatttctctctagatttgcctactctggacttttactctaaatggaattaaataatatgtagtctcttgtgactggtgtctttcacttagtataatgttttcaggattcatccacattatggcatgtatcagtacttcattcttttttattgctaaataagagtgccttgtatggacaagccacatatcatttatccattcatcgttggtggatatttgggttgtttctgcttttcgactattacaaatactcctgacagtcgtgtacaagtcttggtgtggacaaatgctttcatttctctttggtatgcatctaggagtggagttaattactgggtcatatgattactatatttaaccttttgaggaactgccagaattttccaaaggagtcccaccgttttacatttcccccagaagggtatgagggttctgatttctctgtctccttaccagtacttagtattgtatgtctttttgactatagccatccaagaggtatgaagtgttatctcattgttgtcaaccattgatttttgatattataaacaggtttcttttgtgtcatttgcagttagagagattttactctaact

SEQ ID NO: 377 - DNA, 30987 bp, Homo sapiens
aaccaattcaagaactggtgaattattttccatctggaaacactaaacacacttctgagacaaaccccataatatcctaaagacaaaccccataatatcctaaatgtgtgcttcaaaaaacttgaagtaaactgggtgttgtggcttgtgcctgtaatcccagctgcttgggaggctgaggcaggaggattgcttgagatcaggagttcgagaccagcctgggcaacaaagaaagaccccatctcaaaaagaaagaaaaagaaaataacaaaagcttgaagttcataattccaattctctgagaaacaaactcatgaaaatgaatctccagctcaggtaataaagttgttctttttcaaatttgttctgctctttcttctctggccaatacaatcacaatccctaaattaatctttgcaagatgtacagagaaatgactagggcaggagtggcaattgggctataggctggaccttatgggctctcttccccatccagccttaaggaagtatgtactcctaataagggaatatgtaaatacttcttttaaaacacagaaaagccaccacatttaataattactatgttgtagtttccaatgaaagaaactgggaatctaatcttaacagctttctctctgggcacttggaggttatttgtgacttcagtcacttcgctcagtaggatataatgctcagaatgggtaattctggaatgcttagtatttttcaactatggattttgtattgctagagataatataacagctctagtagatgtaatcttgtctttctgcccatttgtttacagtgtcaaaattacctatttgctaaatttaaaaaatcattcttcatgaaattctcttattgaaaataagatgtactaatatgttcgcaagtttaagtaaaagacaaaccccattatatttcattgagagaaggatgaaatgaacggaagtaaacagtgctttatttccaatctcgagaaactaaaggatactccctgagaaaagaaaaacaacctttcacactcaattcacttcattctcctccactctctaaggctctattgtgggctcgctctgcttaagttttctccctcatcattttctaacatacgatatagtttacttagtatgtttattatctgtctccactattatgtaatgcaccagggcagaagttttgcttttttcatggcagcatctaaagtactgacagtacacagcaggtgctcaataaatatctgttgaatgactaaaagtgaatcatttcttcaggagagacctgctcatgatatgccaaataggctgaaggctaaagaatacagtataacagcagtctaatacatatatatatatatatatatatatatatatatatatatatatatatatatatatatatttgagacagtcttgctctgtcgccaggctggagtgcagtggcgtgatttcggctcactgcaacctccgcctccctggttcaagagattctcctgcctcagcctcctgagtagctgagactacaggtgcgcaccaccacgcccagctaatttttttgtattagtagagatgggttttcaccattttggccaggatggtctcgatctcctgacctcgtgatccgcccaccttggcctcccaaagtgctgggattacaggcgggagccatcgcgccaggcctacaaaatattttaatgttagcaatagcaaggctcaggtggaggcaacatctaagttcattataaacaattagcgatgcattgagttaaacaacaaagaaagcctgaaattccactagcaataattccgcatgtgttacggaaacacctagatggggactgttgccgggtttgaaggctcctccgtttgctaaaacttccagcactagagagtttattaaactactcctccaaagcaatgtgccctcactggcccctccccttgagaatcaacctcgagatctagcatctattttgcaaacgaagacagcaggaacgggcgggctaaccgtcgcagtcactgcctcggcgctcctccccctccaaggccagcaagttgcggcactgggggaaatggccgcggcgacaacttcctcgagttctctcgggtcatcgtgaacttgggcaccgaaacgaggatccaccccctccccaccaaagtgcgggagggaaaagaaggctagccagcgagaaattttgccccacaaatccgccagcagcagtggcgggaagcctcaacggcagcgaccccgccgctggcctcgtgcgcagctggtccccaccctcgcgcggcgctccctgattggctgctggcggcgggacggggcggggcgggatggcacgttgccgctgcgcctcgggcctgtgcgggcagtcctccttcacttccccaagtccaccctgactggcttgggtgcacagccagggctagagtgtccgggtcccgcctgggccacaggcgggccctgccaggtctctcagaccttccggtcctcgctgaccagtcggggagtggaggcgtcgaccgccctggcaactcctcgccttgggcggctgggtcgagttcggccgcagggagcgtcaaagacgctgcctagcccaatttcggcgggaaagcggtttacctgctcggacttcgctgggtgcctggcagcccgccgcctcccgaaacatccacgcctgaggtcccctggcccgtctacacccagtccaggccccgtggcggcgcctttctgacccccatgacacagccagacgaggtctgcgggcgggtggctcctggcagcggtcgatggggcacctggccacgtttcttcccaaccagatagcgagcgtttggggccttcacctcgcccctccaagccctcagggacaggctccacgctgctccttctccccgctatcccgcgccctggggccctgatcgccgtactcaccggcccggactcggtttccatcttcctctctgctcttcagagacgcggggtagggaaaagaagcctaaagtttgaaaccaccttcacgccaaggcagcagcgctgcttgtcctgcctgggactctcgccccctggcggcgagggtggctgtggcagctgcagggaagcaggctcggaccccggccctgaacctgccacctggcgggtggggagaagcggactgcgtcgcctcgggtggcaggtggcggtgcgggcgggcgctgcaagccggagaggggcgcgggagggcgagtttcggctgtggccctgggactccgagccggggcgtctcaggggcagagcgcacggcacagcggggcgggcgtggggcgtgcggagcgagggctcggttctgggacccctctcgccttctctcagacggctggggaggagagagcgagcggtcaggcaaagctccatgcacgccttcccctctcctccacttgagaagagtcggcctctgggactggtgggtttcgagaggttgaggtgaccttaaggctttactgaggtagaagaagccggttgacgggcgacttccgaagactggtgtaaagcgaagaaggttctagagtcaaactctgactctcggggcctgactcgcaaaactcgggggctcccgagaagccgcggacgccgctctgcacctgttgccgccgtcactcatcccgccaggcgggcggggccgcgcgggtggcttggtcaggacctgccattcagcccagtcgggctccggtgctcgccccggacggcgccccaagcgggtcccggccccgctgagcacctccagcagtggcacagcctctggaggggtccgggacgaagccacccgcgcggtagggggcgacttagcggtttcagcctccaacagccttgggatcgcctttggaagaagattgcgctttttttcttaaattaatgaattaatttactaattatttttatttttgagacggagtctcgcactgtcgcccgggctggagtgcagtggcgcgatctcggctcactgcaacctccgccttccggattcaagcgattctccttgtctcagcctcccgagtagctgggattacaggcgcccgctaccacggctaatttttgtatttttagtagagacggggtttcaccatgttggccaggcttgaacttctgacttcaagtgagctgcctgtcttggccgctcaaattgttgggattacaggcttgagccaccgtgcccgtccagttgactaattatttagacacgaaggctcactctgtcgcccaggctggagtgcagtggtgcgatcacgctcactgaattctcgacctcctgggctcaagcgatcctcccacctcagccttctgagtagctgggaccacaggcaggcccacgccaccatgcctggctgaaagaagactgctttgtaaataatacgtatttctagtaggtagctaaaatgattacaactggataaacttatagtaatgattatcattattatagctgccatttatcaagtactcactttgtttcaggcacaatgctttatgatcagtatcatttaatcttttcatgctcacagcaacctttcagatagatgctccaattatcgtcatagtacgtgatgaagcagagatttgaaggataagtaatttggtcaagatctaaagctgtaggaggtttaaccctcgtctcccccccaacccacagttcttgatcataaccattttgccacatatttttaaagaatcagcagtaacaactgttaaaatttacaccagtaataactattgtacacactactataaaagtttgactttgggttactttgccttcaagatatagaattaaaaacagagtgaatatattaatttttgatttattcaaagattagctcttcatattattttacccaaaataaaatgggaaacaatttttgtttatcttacccgaagaatccctaaagtcattatacatttctgcatgcaatttaagctcattttaccaggtttcagtctctgtggaaatcgagaatacaaacctatttagatgaaaactcatattctaaagcataataatcttactgttcaataccagtagaactaatcttctttgggcatttttttttcctaggactgttgctggatttgggtagatgttactatcctctcttgcccaaaacattttgactaaaaacacttattttcaagaactacattctcttaaaaaatgtattcagcgcagtaggtgtttaatctgacaaaaatttacgtaatttagggaacgctaactgtatttcaaggctggtgttgggtactagagggatatactttattttcagtgtggcagttctctgttctgcctcttactattaattcttacaccaaaaggaaagttcagctttaaaacttggataaaccacataaaattatgcaatgcaccccaatttagtagacacttaacagagttcctattctgtgcagtacataatggaatataatgtgggagatatgaagatgaagaacaggggtgtccaatcttttggcttccctgggctacattggaagaataattgtcttgggccacacataaaatacataaacactaacgatagcttatgagctaaaaaaataaatcacaaaatctcataatgttttaagaaagtttacgaatttgtgttgggccgcattcaaatgcggcccatgggccaccagttggacaagcttgaagaacaaggtcaaacctctgttctcaaagcattttaaatctagaaggatagaaaaaactaattactccaaacagtataatataaatatgcttataagaaaataaaatacaggcataacaggctgagtgatatattaacaatgatcaacggtctgtgggagaacagaggatagcatcatagagcacagtgtccagggctgggtaagggcattgttaaggctggaatgctggtctgggcagaaaaattgagggaaagatattgagcctgcatcatgtacctaatgctgggctagccacattctttttaagtcttagttctctctttttcttagtctctctttttctctctctcattggaaacctgagtcttagagaggtaaaagtgactctcgtggtcacattgctagtaagtggtggatgtcattttcaaaactttgttcctttttttaaattataccttaagttctagggtacatgtgcacaacgtgcaggtttgttacataggtatacatgtaccatgttggtttactgcacccattaattcatcatttacattaggtatttctcctaatgctatcccccccctaccagccccctacccaacaacaggcactggggtgtgatgtttcccaccctgtgtccaagtgttctcattgttcagttcccacctatgagtgagaacatgtggtgtttggttttctgtccttgcgatagcttgctcagaatgatggtttccagctgcatccatgtccctgcaaaggacatgaactcatccttttttatggctgcatagtattataccatggtgtatatgtgccacattttcttaatccagtccatcattgatggacatttgggttggttccaagtctttgctattgtgaatagtgctgcaataaacatacgtgtgcatgtgtctttacagtagcatgatttatgttcgggctcagtgcactttgtcatgttacttatactatggcaataaagagaattttattctggagacctttgtaaatagggaccattgaagatgattgaaccaggaagttgtataatcagagccaaattttaggaagatattttcatatcaaagaagagtttttgaggggcacagactggaaacagatagttgaatttggaggagaaaacaattcaagtgaaaaataatggggacctgaacaaaggtgacaggagtgagaatcaaacactgggaaaaggttaaagagataccagtgaggaattgagactgttgggcatgggtgatgatggagagggattggtgaggctcattcagaaatctggtttcacatatgggagatactgtttaccaagataaacataaaagtatagcacattacaaattgcaaacctaaaaatcccattttcttaagttttctgccaggttcccaatgtttctcatcttttttcttcgcacaatctgttcagaacatagtctttgtttcagggatttacccaactacccttctttcttgccttccctagttgacagttcttcccttcttgcctcttgagttttctaacttcagattgaagctcctaatatctacttctggctctcattttcttgataaccctttggatgcattctctagtttatagatgtggataactattttgttcctcctgtgggcaggctttatgctatggcatgggatacagcaatgattaaggcctagttcttgctctggtagcaagacctagtggcagcctgtgatctagtgcaagaagcagctaagcagcctgtggtctagtgcaagaagcagctaagtaagtaaaaagtttatacattcattgtgctaagcatggcagtagaagagttgccaggtacagagatagcccagaccagggagtgatttaacttggtagataaaacaacatgaaaagacatgtttagaagatgcctctgtttccattttattttttttcttgtttccagatctattaacttattgtttcattttggaggattttaggtgctttctttttctctgtaatggttggatgtttgaaataggagaggtgagggatagagtttaaaaaaatgccttaagaaagcaaagaggacagctcagatcttcttttctcctacagggagcacaacacttagacttggagaggttgttacagagacgaagactagaacaatatttgatttattggattttttttggtaaaaattagttcatttatttgcttacgctgtttactgtgagcactacttagatacaagaacatacaatatagaacctactgactagcataaagtatgaactcaaaaaatatttgtagaataagggaataaatgaacagataagcctcaccccataccacactttgtctaagtccccaccatttgattcttactttagacatttggaccattaagaggctcaccagctggactgtcctctaatccttatcggtagaatgagatcagatacttactttcttgtccttaactcacagaagtgaatttggacatgtttaactgtaaaggaaagttttagttgtgatgcttagtaagaggtggctttttttttcattaagatataaactaggagacttcttggtactttagacaggctagctcatggctagaacacaactgtccttctagaccactatgacatccttctggattaagagtgaagaacaattgattattgccagataacctttttctttgttccttttccccctcaatggatatgtggattctaaattttaattgatttctcctgattgattttcccataacaatttgtgagagtacagattccttttcattggcacactgtaagttctcactctcggaagcttctgccagcctggtggtaggcaaatctaaaaagctcactggttggtcctttaatagctctgatgttctgtagttcttttttttaattgacaaataaaaatattttataagtgcatagttgtatatatttatgtggtacgatgtgatattttgatatatgtatatattgtggaataattaagtcaagtgaattaacatatccatcatctcatctgcttatcatttttcttgtggtgagaacatttaaaatctactcttttagcaattttgaaatgtatcagtaaaacttattcattctatctaagtaaaattttgtaccctttgaccaatgtcctccctttttctgtttctatgagtttgacttttttagattctctatgtaagtgagatcatgcagtatttgcctttctgtgcctggcttatttcacttaacatattgtcctccaggttcatctatattgttgcaaatgacaagatttcctttttaaaggctgaatagtattccattgtgtacatataccacattttctttacccatttatctgttgatggacgcttagattgcttctatatcttggcttttgtggataatgttgcagtgaacatgggagtgcagatatctctttgacgtacttgtttcagtttctttgaatgtatacccagaactgggattgctggatcatatggtaattctatttttagtttttttggagaacctctgtactgtttttcaaaatgactgtacaaatgtacatttccaccaactaggcttcccttttctccatatcctcaccaacacttatctttcacctttttgatgatagccatataacagatgtgaggtgatacatcattgcagttttaatttgcatttatttgatgattagagatatgtgtcaggtcttattcatttttgtacactgtgaacttaactctgtaatgacacataacagacattcaatattttatcttaaactattgaggtagagcagtagtaccccagggatatgggaataaaatattagagctcatatttttatttatctaaattgataagaagtaaatcaagctttgctaatgtttgatatgtagattccactcttacccttacttggtccatatatgggtaaaaatattttgagggaagattgggagttctagaacatggagaagttgacagctccaactcattgcctggtccatgagcccagctaaatgaattttaaattatgttgtgttagtttgaattaaactaactcaagatggatgcatggcttaaatattccagagaacataaatcaaagataattctagtgaacatttcaaaaattgcagagcgttcccttcttctattcttactacaagcacgtcctcagccacatcatgaagtaaaaacaatgacaatatatcttataagaagtcagctccccaaaattgactttttagtatgtggatgtacaccctcttccataaacaacagaaggccctaaatggatattgtttcttaagatattagctaatggtgatataaagccatcaccattagcaaaacattttaaagtaatatttgcttcatcttcttaaaactctttggtgtatgttttataatgtgcataaatactaacatagagacatagtaaatgatgggcgtcctcaaaaaccaacaagaatttgcaaacacaatgtgtggaaactcctacagaagagcatggtcctcaagatctgctttttttttgttttgttttgttctagaaggcagaggaaatacacacttaaaaaggcagacacacttaaaaagatgtaaatatagtacactgggtataaaaggtattaatggagaatacatggtaacttgagggttttggaaacactttctggaaaagacaatgtctgaaatgaattttgaaggagtgatggttagctcaaggaagagaggtgggaaagggatttcatataactaagaggtgaaagcatgaaatgcatttagtattcagtggatttcaagtagtctgatagtcctagagtgtgaaagaagagaagtggtgtagccagagaggattccagggatgtagataggagccatggccatgtgtgccaaagagcctggactctattcagctggcactgggaagccaatgaatcttaatagcgggaagtcagatttgtactttacagaaatccctctatctacaatatagagggaagatggatattagaacataacacatggtcactgtaatcaacttaattggtattggatgggaatcaggacaatccaaaagtagattgaagtacatgtagaaatgtgatatatgacaagaaggataattctattcagtgaggagacaataggattatttaatagcgttggcacaaatagacattcatctggaagaaaataaaaatagacccccatcttattttaaaaaatttatttgacacttatacacactcattaacacttatataaatataaaaaccaaatttagaaataaattataaacagaccaaatacatagtttcaaaaagaaataaaaatcttgcagaaaaaggtaggatttacatgtacaatctaggggtggaaaactgcattttaatcaacagtggagactcaaaaattataatcaagctgatagacattttttgattctgtgaaaattaatataatgtgcaggcaaaagtttccataaagttaataaaggattattctagatagctattaatgtagatgacataataaggataatatttacaatgtgctgattgagttctctgggaagcatatggagttaggggtgcaaaaggtttataggggtgcaaaaaatatttgggggaaaagggaggagcaggtggtgccatcacttctgttacaagctgactcagccagccaagtgggagctgtggagcaaggatgtctgttggtggagtcctgtgatggtggaaatggagaagggcatgccctcagctatcactgcctcactcattcattggccatgggctgcctgaagaagaactttatgatcttggttcaaatttgaggtggaccctgaataagtgaatagctgcaggctgtcagtgaaccttactcctcgcagctggggactgagtcctttatcgtagcagggtctgggtgtggcaactccatgtttgccataaaactcttacaaaatcctgagaaaatggcatttgatccaatagaaaatagggctaagcacatttgtagacaacttactgaagatcaagaccaaatggccaagaaacattggaaacaatgcttagtaatctggaaagtgaaaattaaaataacaatagactataactttatacctataatagtcacagaaattaatcagagctacagtaccttttaaggtggaatgtgaagtattgtagctctttgggaaagctatcaggcattatctatcaaaggtaaatatacgccttagaccctaaaatttgactcctgggagtctatcttatacaaataaaacctttggttcataaatatgtgtataaaaatgatttttacaacattgtttgtagttgtgaaaaactagaaataaattggataccctaaataaggcaatggctgaatgaattatgatatattcacaccatggaaatactatgcacttatttaaaagaatgaataagtagctattgcagaagaggtggtgggattttttactagctcttattgaatgaaaaaagaaaaatgcagaggagtattgtattagtctgttctcacattgctgcaaagattctatctgagactgggtgatttataaaagaaagaggtttaattgactcacagttcagcatggctggggaggcctcaggaaactcatggtaatgatggaaggggaagaaaatatgtccttcttcacagggtggcaggaaggagaatgaatgaatacccagtgaagggggaggccccttttaaaaccatcagatcttgtgagaactactcattatggtgagaacaggatgggggaaaccatccccatgattcaagtatcttcacctggtccttcccacaacacatgtggattatgggaactacaactcaagatgagatttgcattaggacatagccaaaccatatcattccacccttggctcttcccaaatctcatgtcctcacagttcaaaacataatcatgcccttccaacagttccccagaatctcaactcattccagcattaactcaaaagtccaagtccaaaatctcatctgagacaaggcaagtctcttccatctatcagtctgtaaaatcaaaagcaagttagttacttcttagatacaatgggagtacaggcattgggtaaatacacctgttccaaatgggagaaattggccaaaacaaaggggctacaggccccatgcaagtccagaatccaatagcgcagttactaaactttaaagttccaaaacgatctcctttgactccatttctcacatccagggcacactgatgcaagaggtgggttcccatggccttgggcagctcagcctccatggctttgcagggtacagcccccacctcctggctgctttcacaggctggcattgagtgtctgcagcttttccaggtgcatagtgcaagctgtaggtggatctaccattctggggtctggaggatggtggccctcttctcacagctccactaggcagtgcccctgtggggactctgtgtgggggctccagccccacattcctcttctgcactgccctagcagaggttctccatgagggctctgcccctgcagcaaacctctgcctggacatccaggggtttacatacatcctctgaaatctaggtggaggtttccaaacctcaagtcttgacttctgtgggcccacagggtcagcaccatgtggaagctgccaagacttggggcttgcaccctctgaaaccatggcctgagctgtaccatggccccttttagccatggctagagtggctgggatgcacgaaaccaagtctctaggctgcacacagtaggggggccctgggcctggcccaggaaaccatttttttcctcctagacctccaggcctgtgatggaaggggctgctgcaaaggtgtctgatatgccctggagacattttccccattgtcttggcaattagcatttgtcttctcattacttatgcaaatttctgcagtgggcttgaatttctttccagaaaatgggtttttcttttctactgaatcgtcaggctgcaaattttccaaacttttatgctctgctttgcttttaaacataatttccaatttcagatctctctcaagttcaaagttccacagatctctaggatgggggcaaaatgccaccagtctctttgcatagcaagagtgacatttacttcagttcccaacaagttgctaatctccatttgaggccacctcagcctggactttattgtccatatcattatcagcattttggtcaaagccattcaagtctctagaaagttccaaactttcccacatcttcctgttttttgagccctccaagtctctaagaagttccaaactttcccacaatttcctaactttttttgcaccctctaaactgttccaacctctgcctgttacccagtttcaaagttgcttccacatttttgagtatctttatagcagcaccccactctaccagtaccgatttactctataagtctgttctcacattgcttcagagatactactgagactggtcatttataaaggagaaaggtttaattgatcacagttcagaattgctggggaggcctcaggaaattcacaatcatggtggaaggggaggcaaacatgttcttcttcatagggtggcaggaatgtgaatgaatgaacaccaagtgaaggggaaagctccttataaaaccatcagatcttgtgagaactaactcactatcatgaggataggattggggaaactgcccctatgattcaatgatctctagctggttcctcccacaacaagtggggattatgggaactaaaattgaagatgagatttgggtggggcacatccaaaccatatcaggtatatataagattatctctccccctcatttttttctgctaaacagtgacaaaatatactttgtttatgtgtatatatatacacacatatacatatacatagatgaatgttaacttgagttaccttgcaaggagtggggagggttgatgtgggtggaagagggaagatatgtccaagataggcaaaagaagaacaaattgtaccaaaaaagcatacatatgatctcattatgctataatttctaaacctagtaagaaaggcagaatcggggcttacacagcttgcagtaaagagataaatgagaaaaatgggtcacagaaatggaaatcattatatgcaattttattggatatataaaagtttttagtttgtaccagtttactagatgccagaaatgtttactggttacatgtgaatcaaacagtatccggccatatgaactgaaagcatggttgtggaaagcacagggctttcagtaaacttacatacctctatcactcagcagaggctaggttatattacagtaacaaatgaccctcaaatccaaggggtttacaacaaaggatgttttattgctcatgttacgtgtctattatagattggcttcagttctgctccatgccactttcactcaggattcagcccctgtctggtgaacaatctcgaggctgagaaaatgagatcatagttaaatttatgctggcttttaaagcgtctgcttagaaggggtttctttcactggtcaaagcaagtcacatggctgagcccactgtaaatgggatgaggatgtatgaccctcctccagggaggatcagtaaaaatcccccagggtataaagatctgctttatgacaaagagtgttaatgaagtgtttccgtgtgatcacagtagtgaatgttattaatgattggtggattaatgagtggtgagaattaagatgagaaataagaggaaatacattgtgtatgctactttttataattaaataaatgctatttttattatccactgggtgttaagtataaagacactccttttgatttttttttgtttcaatcacagatcacagaccatctcatcacattttcataaaacaaagtaaaatctctttaatccatatcctgaatatagaaaaattatggtaggcagaagggtaaaattttaactacatattttacttttctgaattttagaattcacagtagcttattgatgagaaatataatgatcatcacaaatcagaaaacatattccttcctttataaattatagtataaaatagtactgttttgtggtttttgcccagagttaagtatttgcttgtcaaagaatcttccaagtagattttatctgcagctatcagtttagttattaaaatttcattttggttaggagaaaatttgaagaaagtgccgcaacatcttattacacaaaatgtacggtgcttcttacttgttattctatttcacaagttaaattaaatttcagtcctttactgttgtctaatatttcagatgtttcctacaacatacttaaaatttcaaaaacaattgtaacattatctgaaatgtttcaccagtacaatttatacagaacagtgaatggcaaaagtcccaagtgtggttcaacagctgttgctcccgtactgtgggctgagtagaggcagttgtatccatggtgacctatatgacttaatgagagtgggaactgcgtgattctcacaggggttaatgacagagcaaacgctggcaagccagctttcatgaggcatttggcttttttttgtttgtttgtttgtttgtttttttttttaaaaggaaggattcactttttctaactcctcattttgtaaagcagacaaacttcgtatcatgcttaacaaaagagctatatacctgaaaactaactcggaaaaaaagggcttacaaaacaaactatactttacttttgtcctatattttaatgtaaaacatgcattatgattttatatttattcaaatattgcactctgcttcttcctcccgaaaggtttaaggtagactagaacaaaggcatatcaataaagtctataaaataggtgtaagagtcttacacattatgagtggagaaaagaagtgcattagaaaaggaaatatgactctgcagtttcttccaatgggccctgtgacactaaaaagcattaataaacttcataccttggtataagttggaggattaaaaaccccaacatcgtgtaggtgatttagatttgaggaatgtacctgggatttgggggctcgaggggaggaggaacctactgtatattcacttctgcattgaaaatgtcaggcattgggtgtatatctggtttgaaaagatttctgtcataacgttgtacctggaaaagattcggttgtcaaataaaacagagaatcaagtttttatgggggccttatttgtgccatttcagtggtacttttcctaagtgcctctggcttctgcatcagtgggggaaaaaaccgtgacatgagctccaactccaggatccacgtcaaagtaagttaatacatagaaaataaatcaacactgtctatttttaaaagacctttgccatgcacaatacagactactgccagatgattggcctggagctcctgatagtgccttagccccagggtcttcatggggtaattcctgtgggaatggtgttaatggatagaggcccaggcattctgctctcctgcagacagtagagatttctcaacctctgaaagaagcagcagtaatcagacattgaagaacattggctgtaattaaagatttcttagattcattgcctctcagtactttaaagatttattaaactggggaatctagacctattataagcaatttgtaacttctcatttttgtaggactgttataatggagcacactttacttgttctttgaaataagattagttgatttttatgttttagttactgaaatttcttaattcctaatataagtgacaaaaactttcaagaaaaaacttgaatttcaaagaggtcatatatcaagttttgcttatcttttattgacttgtatgtatttactctactataatattcactctacaaattaccctacaaattctgttttcttgagctagcaaaacaaaatgatcaccatgtatattggggagggctatgactgaatgtaaagatgcatgcaacttaactgaaaatgctgtatgtcctcttctttgattacgtgcaatgcgtcctttaacttattaggagacctgtctcaatataaaaatatttttcttacacatatgtgaatgagatgataaatgtgtttcctcatgcactaatgaatcagtcatactggtggtccatgctgatgacataaaggtcatgttgatgttgagagaggaggttgtcatggttaatatgagtggtcccagatctgaaggagtggctcttcattctccaggacagctactggacttgtatcttatgagagctttgggtagcaggaagaatgcaggctttgaagtcactaacattgcctcaaatgctggttctttcacttcctagttggctctaacttcaagcaagctacttgacccttttgatccccagttttcttatctgtgaagtggagatcagaatactgcagagaggattatctggtacatagaaagcagttatcaaagagatagttcttttccccccactatgacttcctggtagtatatggaaagtcttaatattctcactggttttttctcaggcccagggttctggacttccctggctggaaggactatattgacatatctagtcttttagtctggtctaggtattttcaggactgctagaacttgcttagttcttattggttgtatttcagtctaattctagatttcaagtcattccaattaataagtgcccttcttctgagatttgtagctgcttggtgtggatctgttctgatttctgctctaaaatggaattctaggatccttgaggatgagaagttctaccatgcagacagtgacagaaccatttttctttatcagattgattattttatttagtcacaggactgcaaaagtcctctgtccataaatatttattgagcacttactctgttccagacatagttctgggagctggagatacagcaatgaataaaatcgcaaggtctttaggcacatggagatggcattctacatttcagtgaagcagagatagggggaaagtaaaacagaatatgtaagtaaacaattccacggaaaagacagtttgttcacagtgataaaatcctgtgagaagacaaaacacaatatgactgacatgtactgaggcttgtaggggcaacttgagatttgtagttagagagtcctttctgacgtagtaacatttgaatttcctgctcgttactattattcatatcttaccttcctacccctgctcacccccaaattccaatctgccaatctagcaattgtcaccatgacttggtaaaaggttgggaggcaagaattgtaggtgacagctatttggaaagagggactgttaatgcaggggtaggaatgtgcccatggctgctgacttaactgaaactagctagtctctttcagtttttgaagtgggtccacaaagcagaatctgctcctggctaggagcaagtacataggaggggttttttttttttcaattgcaaacatgagtatcaggaaaagccttctgagcttatgctggaacacaacaatataaacgacttgctagattagggtccaactagtttatcaaagcagagtaatttagacaacaatctttacggatagaggctcagagcaaaggaatcagaggggtgtgtgtgtgtgtgtgtgtgcactttcacatgagggtgagagggaaggatgccaaggaagagaaaagagtccaactagacattgtctagttgaaagatacaacattttgcaagttatatgctgtactttctggcctctgtttttttttaaatcactgaccttgaatgtttgttaataaagtgatgctaattttaaaatttgtaaaaataaattattatcataatggtacacaaatctgtaggatgaggaacttataaatgacattaatatcctataacaagataatgagtgagataaaggcagttttacatttttcagaggacaaccgaagaatgggacttttattagagtaacaaagaaaaatgaagcactgacaactgtaaatgacagaagtcaaatgtaataatagttgaatatcaaagaaaaaaatgatagcctaaaataagatatatttctgaggatagcaattaaaaatatttcctatatagcatagacaggaattccctgaactaaaggagatggaagacatgtatggttgttttaagtctgggtacactttattttcttcctctagtctgtgcgttgtaaaggcatacctgttgaaaaggaaacttttgttgggttacccctcctgtcttttaaagatgagggggaaaaagaagcctttgctgttatggatgcagttctcagaatctcactagagggtggtgttggttctaaaaccagaggtcactgctactctctacagtacattcattactaggctgcatttatgtttaaagaaaaggcaaagtcaagccttctcagtattccctagtagttgataaatgtcaaatctgaaacctcccaagtgcccctgccagttctggctggttgtagcccagaggagacagataaagtagtgaagagattatcggaggagttgggtggctgattctaattttggctcctgcactaactagtagacaagactccctgggcctttgtctcaaccgtaaaacaaaaatgatgtcctagttgatccctaaatccccatatatctctaaaattatgagattcaaaccaaattgttggtctaaaatgctgaataatttctcatgctgttagccagactaaggaacaagtaaaatctcaaattattaaattattaataagataaaatgtaatgttataagtgaggtttaatatagattctaatatcaaaggagtttaaaattaaaatgccaagtcttttgtcttaccagggagccttaggaccatggtttgcatctgagcattctgtggataatttcagtgacttaactcatcatccaaagatctctcccttcttggttgctagcttactggaaatgagcaaaatatgtttttatataggattatatagagaaaggaggctgaaccattgtcaaataggaatgttttaggatagagactaaactccccacctgcatttatctgacttggattatatctgtgctttttaagagtcagtcttcggagggatttagttggttcagtttcctttcaccctcatctctttcactgactccctttccttgttatatttactcacactgcagaatgaccttagaatcctttcctggaacctgaagcaaattatggaaccccaagatcccagtaaaccctagtttatctctgcatggacttgacttctaagaattggcctgagagcctgcaattaacctgtgaccacgcaaagcttcaccccgtcaccccaaacgcttagacattcatactcaatacccactttcctccaaattgctttgtttggcagaagaaggtttctttctcccctctccttcacccaacctggatttttgttgcatctcaggctcatttcgcaaatctaaacttcctaaaatatacacggagcgcctccgggtttgcacacgcgcgcgcgcgggtacaccctggctcgagtacattagccccgctgggccggctcccagttgcagaacacattccattcttcgcgctcgggcacacccctccgcagtgaggattggtcgggccgagccccctcggcgaggcgaggctcctaagaggcccagacgcctgccaatccccaagggctgtcaaaacaagtctccctccctgtcacaacagagctgagtggaggccgccgccgccgccgcacttcctgggaccgctgcgccgcagtccgcgggcaggtggcgggtgcgcccggccgcagtcgcccggctctggcccctatcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggtaagcaaagccgcgccgcaccgggagcgtggctgtgggtgatgggtgggtcagggacccgggcaggatgtgcggtgtccggaggcatccgggctcagcattgttttctcccacctccttcaacgccaaaccttccttccttatccggaggttcccagactcagctgtcagccacgagacgcacaagtgactttttctccccactgacggcagaggaaaagttccgctctgcgtctttgcgttctgatggatgctttccctcattttctctgcaagcttcactaaaccgttgatggagggaggaagggagaactctggataaatgcagacccaccggatggttgtgcattgctttccaatgaagggttagcttttcccatacaatgaagaaaatgcacagcttactctcaagtgtaaaaaaagaatccctctagacttaaatgatcccgaaatcccaagatgtgtgaactttcccggtagggaggcagagttttaagtggaccctgcatcacagtaaagagcaatgcaagagcccagagtttttgcgctgcagaaagcacaaccggaaagcaatcaatcccccaagcattatcactggtccttgtggttaccaccacatccagggaaaacgcttcctgacccgctaatcacctcacagaatttctctccatccatttggcaaggaatttgtaaacctctttcctcccctttctctttccatcttccttccacttggggcttgtttcttctgttcgagatttcctcttttgggagcatgactttggggtaaggttatttaggaaagaaccctcgcacaggctctggaaaagggcctcagtgtaaatgcatgtgagtaatcaatcaaatgtatgtcagattaaaattgattttggtggagcagtcagtataaaacgatatgtatgtatgtatatatgtaagtatatatgtgtgtgtgtacatacacacacacacatccctcaatgacaatgaaagatggacttttacttactattgaatttattgggttcactaatatattcaaaagctctgttcagggttaagctgcgtaaccagtgcatcacgcatgttgcaagctcccagcaccagcttaggtagactaaccacagaatgtggctccagtaaagtctttttcccaacactgacacatggaagtttaaaatcagtggagaggtttctataatatataaagaagagtgggtggtaattacaaatggcttgtagtagtttctgttattttgtggctttttgattatgtaacaggagtgttctattctgggtgtgaatttggacaaagggaaattactattttgtttttaacccacaggtcagaaagcacactgttttcaaacttaaaaaacatcacaattaggaaacacatacattttggattctactgtattgatactacatggtgtcctgtgtgtgtaaaacaggcactgcaagagactttaaaatatatgacaataaagagcaaacggctctataatgttgtaaaaaacaaaagtaatggagtataaggaatatacaaattcttgcaactgagtttgccacttgtgaattgtactatgctggtttatattctcagaagggtcattgctgagtaatggtgcctcttttgttttgaagtttctttttgtgacaaaaaaggagggagacaacagaatattaacttgatttttcccctatttaatagtaaatgcaattaacatttggtaaatggcctttaaaattaaagatattagaaaataaagtgaattattatgttaggtttttattggaaaagtagcacatacatataatttaaaaaatcaaatgttgcaaaggagtgtgaaggaaagaccctcagacactccacattcccacttatgtagtccaccctcatagatgttaacactttcttatgtatgcttccaaaatattccatgcatgtgtaagcagatatatctatatgtgtctatgatgaactatagcagctcctgatttctacaaaaaaatctggctagagttttacaagtctcatagttttaagcatttttgaagcctagagggggtaatctggtaggtctttggtgggcagcagtcattggggtctgttcccagaggccttaacgcccttctaaggagaaaaaaaggcaggtggtaagctctgttccactccgtctctgagatcaagaacctttctggtgacattcttgaatctgctgccctgtggtttgttccctttagcatagtaaaaatgagtttccaaaaaaagtttagatcatataagaaatacatagcacatgttctatattgagagaaaatgcatttttcacagttttgccaagagatttttttttaaatttggcattgaaatgtacacaaagaagaaaagctttagtacattttaatcaaaatattaaatgctgttccaaatagctgtagtgcagtaataattgatattcataatgctgagccactgaaaggttgtgaatcatcaaatattaaattcttgtcagctcaatttaaggtattgtttcagaatagtgctatcctgacagaaaacagactgtcttgtatattaataaaaagaatgtttttagtaaatttgccctccataatttgtgaaaacatgtgtttagttgaaaaaacaattttcttctgagctgaggaaaacaatgacaacatttatctgtatgcatcttcagaaattctttctactgacattgtgtttcttccccacatataaccaatcctaggtttaaaaacgttcaatgtgagaattaaactaagtttttttaaaatctgtctactttttcctatatttttctgtgtgattgtttcaacagcattgacattgataaatgctgcatgttttttggtaagcgcattgttatataccacaataatgcaatagaatccattttaatttcttcttgatgacttgtggtttgaaatgacaagttggatacctgcagtattgataatctctaaaagttgtttactattctgcatttgaatatatttctaattaagaaataagaccatttatttatctggtatttgatatcaaacttatagcatttaaaatatttaacattttagattattgcttatagccctataatctgctgccctgtggtttgttccctttagcatagtaaaaatgagtttccaaaaaaagtctagatcatataagaaatacatagcaaatgttttatattgagagaaaatgcatttttcacagttttgccaagagtttttttaaatttggcattgaaatgtacacaaagaagaaaagctttagtacattttatattaatcaaaacattaaatgctgttccaaatagctgtagtgcagtaataattgtaatgttttggaaataggaagcagcatagcttatttactatattagttggtggaaactgagctacatgtgtattttaaaaatagcagttgatttttcttccattgtatgtgacacattgacgggttctactttttttcaacttccttttgttctacttaagaacaaattctctaggcaaggaagaatagaaattgtcacttggatctcatggacatgggtgtgggggatgaagatgggagttgggaatgaggtgttgagaccagcactggagcagctacttgggtgttgttcatgtctcattattttatatcatggcgagtctcactctctcatgtcatcttgggctggtatggtggatttttgaactgaagccttaaaggtgccccttgggtaccagtagacccctatcaagattatggctttcctcagagaggcaagaggaatgcagttcacattaagtgcctactactgtgagtcatatactaaactaggagctttcgtacgtttgtatcacttaaacctcacaggaaactctctaaagtatggaaggaaggcacagagagctactgttaaaatgtggagtgatgactgaaagtcatgtctgcttaatttcagagtttgtgctcttgggctggttctcagatgcaagaagtcccacaatccatcaacacttctaggtttgaaacagcccgaacacgtgagatagtgacagaagagtacgcatcttaggtcctatggtttgtggggtacattatcttttctcagccttctttccttcagttcagaacatttggaggttgattattctagaaagggattgcaacctcttctgtctttggctattttgttaggcctgtgctgtacttgaaaagacagagcaatctggcaggtgttctgcttggcgtcaatatatggagcttacatcctattgttttaccccaggcccactttccccatacccctgcagacagtggagtttgtgaagcattgtattctcttttaggctgatacgcaggcagaaaaaatacctgggtcataggaatatatataaatctaggggagtaaggaaatgggggaatcttcttttggagctctgaaagtgtgtgtgtgtgtgtgtgtgtgtgtgtgtgtttaaatagggacggttatgaagggaaattaaatgtgattaaaaattagttaaaaattttaggcactctatggattatataggcgtttgtagattgacccaggaattaatcagcatttatagattttattctctacaaatatgtgttaaaagttccgaataaccaacttatggatggattttggagaaataaccagaggagctggccagcctttactttaccgtaagggttgctgagagtgtgccctgggggcttcagctgcggctctcctcccgagatgtgatttggctgcatgaatggcatgaacctcttaggtagatttggtttatgatccccacaacttcagttagaatgttactttctctcaaattgccatagtaacatggtcacatttcaccttagaagtggttgcttcttattgcagggtctttctgatgtgatttcttatagcacctctcaagaaaatgaagaataaacttcaggtaaagagctttgtcttactttgatgaaaggtttttgaagtgtctgttgattagtgtttgctactattatcagaatttacaaagtttgttttcccttttggaaaatatattaaggctaaaaaaagtgtaagttaattacatagccattgaggggttaaacgtgcattgtgattgagactgaatagtgttttcccaacctttccctttttacaatggagaaaacaggtaattaaattttgtacagtaaaatgtcaattgaacatttattgccaaataacacctcaggcatagcagggcattatgaaaagatatcaggagacagccgaccttaccttggtgctactgaacaagcaattcattaactgcttctaggcaatgccacagcaaactaatcaggcagtggcccaggcagtaactcaatgaaggaattgcatcagtcttctttgcgccctcactcaattctgttcagctttaataactgtgaatattaaaaataactccacattcaggagcaatgtccaaactgagatgtgcttaacactgtatattttaaaaaactatccgactttagatgaccagacagagctaagaggcaggatctcagcaacagtaaatgagccattggttataagaaggagggagagaatcattgtgttggactttacattgaaatctaaggtaataaatcaataaactttattatagtgaaacctttcagttctgcaaaatcttagtgttttaataatgtaaaagaggtttatttgtagttttgttgactcttattcacctccctatctatcctagatcatctctgtattctagttcctgtaataggaaacaatagacagagtttatggtaattaatgattatactaaactgacaataactattagggccaaacggccaacttctgtaacaacaacattcggtcttacatattggcaaatgtattgtgtatttcagctaacttttaatggcaacaaaatcatagtatgacgaagtattggaatagtccattggatttaaaattggatttcatttgtagttttatctgtaacatcttttgtgaatataagagagagatataacctagtttattttcagcagtgccgtttaaactcatcttattaataatcaatctagcattactttgagaaaagtaggattgtacatggtgagtagaaaagaagcattgtttacattatcattatcacttcagaaagaaggcaagttaattttgaaaataataaaatctatcaaggcaaaacaacataaactattttagtgtgtctcgtttccatatatttcttaatttgtatttgtaaatttatgaaagtgtgtagctattataggcaaggttattgtgtttttccttaactatacatcttcatattcaaaagtttaaaatacctttgaaagataatatctgctttattaattcttatgctgacctttttcaagagcctttaatttttaacattttttacttcttttctcttgacttttaggttcagggggtgtacatgtgtaagtttgttccttgggtaaattgcatgttgctgaggtttggtgtatgaatgatcctgtgagctagtaagcatagtacccaatagttagtttttcaacccaagtaccctaacccaaccttccccttcgagtagtccccagtatttattgttcctctctttgtgttcatgtgtatttagtgtttagctaccacttacaagtgagaacatgtggtatttggttttctatttctgcattagttcacttaggataatggcctccagctgcatccatgttgctgcaaagcacatgattttgttccttcttatggctgtgtagtattccatagtgtatgcttcccacattttctttgtccagtccaccattggtgagatgattccatgtttttgctattgtgaagagtgctgtgatgaacatacaagtgcatgtgtctttttggtagagcgctgttggatatatacccagttgtgggattggttagtcaaatggtagttctgttttagtctctttgatgaatctccacactgctttccacagtgactgaactaatttacattaccaccagcagtgtataagtgttccattttctccacaacttcaccaacatttgttgttttttgacttcttaataatagccattctggtgtgagttagtatctcattgtgattttgatttacatttttctaatgattagtaatgatgagcattttaaaatatatttgttggctgcatgcatgtctttcaaaagccttttaaagatgctaagtatgtactaaacacagactaagcccaggcaatatgtataagcaggcaaacttgtattatttacacggtacaatatcacggttagaaatggtgggattgtgatgctactgagtatttagcaatcagagatactcaaattcagaacacctgctctgtgagacattctctgatgtgagggagatggatgcacaaatgaggcaaaaagagacaaaagaacactttagtgttatctgggaccaaaattacaatgtagaaccctagaaagctagacctgaccatgttgtaggcacttttccctaaggcccaaacgacttcaaacaaaagcaagccaaataacctgtatacttaaagcccacaccccacctcccagatctgacagccgatgatgagggtgcgcacaccttctagggtgtaatcaggggcacacgcattagggctagacaataaggagtcagagacatggtcagcagggggagagtatgtttcccctctaagcctcccttggctcaggctgggttaaggcctggttcaggaaaagggtaatggcatcagaagagtgatggccctgctcccctacaggtcagccctgattgttgggttggggaggagagagagaagaccatgctatgtgcactctgacctctctctcctttgaaagcttcctccccatataacataccccatcaatgtccttgaacttgcagtttcttaatcattgatggtgactaatgtttggaagtgggagtggggatggaggtgagggagttggagcctcatgctccccctagaggcgtatataaaagatgcaaagtcatcttcagcatttagtaaactccagctttgaaatattttggaagtattgatttcatatcataattaaatattatatatttagaaatgttattaatagtaagtagctttatttttatgtttaatctaatatataaaacacctagtaacatcttgaattggttttcctactgagcaattttctttataataatagcaaatactaatataatttgtatgatgagtctagcattgttttgagcattaacgtgtgtcaaataatttaattctcacaataaccatatgatatgcatattattattatctcgatttttacagatggagagatgttaagtgacttgcctaaggtcacatagctaataaacgcagagccaagaagtaggtccaaataatctagctccagaggttgcttttaatctttatgctatatgttcttatcctctaaaacagtattgatttgaagcttagctggtgtggataaaatagcagattttttattgttatcttaaacactaagttcagctgacaaatcaaaaaccaatttttaaaacagttttgggaaactcaaggattacttgaatatacattttttctcagtttcata

SEQ ID NO: 378 - DNA, 28068 bp, Homo sapiens
gaagtgactagcctacaactgaacttttttttagttctgtcttaaagggggaatttggtattttagcactgttttgagcactgttattaattgtgatttcctttttctgtttttcagtaagcaaatgaatcctttcattgaggatattttgaatagaatacaagatttattagagctttctccacctgtaagtatctgtctctttaagatattttacccagaattcattgaagccacacgtgccattagccttgcctttgttggcatttaaaaaaaaaaattggtggtggagggaagtgtatgtgcaaagattagttctatttaccaaaattctgttgacatagtaaacaaaacatagtaataggaatcaagagttgacagatcaatttggcagcatggggtatattgttaaaatgttgaagcattttatgaagaagaaaaaattcattaaagatgagcttgctgttaaaatgaaaagtatattaaaaattttaaaaaccaaaagaaaataaaaatttaaaaaattcaacttctaaattattctgtttaatcctataattgtattagccattcttagcagctgctactgttagatcgaaggttttccctgtcatttcaggcttagggtaaaaaaaaaaattaagtgctagtcgatctgaatattttggtgttgggattgggccataatcccaagtgttaaaatcctgaaatcctaaaaaccacaattctaaaagatcaaaatcttaaaaatataatcctggaaaaagtaattttaaaaaattatttgaaagatattactttacatttttaaaagggaatgtatttgagaaacatgtaaaaacatgacagcacttcataggccactttacacaataaaataggcaataataacatgcttttgcaagcataaacagttataaaaatgacagttacatgtgtaaaacaggagcagacaaactgtattcataaatcagaaagcaaaatgtgtaagtgcatgtcactatggttagtagttgtgtgccactctgctttataactgcgctcatctgaaataaccatgacagacaacctaagtcttgaggaaattgataaaaaacggcaatgggtcactacaacatatgcagtcacccaaagaactgagatcacaagaaattttatgtttcacagatgcagatgtacagaaaggacctttcttgtgtacatgcagtgtttacacacacagttaatgctgtgtgtaatgtacttttgcagagtcaaatttctgatgttcaaggccgcagaagaaaagtctgtccacctttcagagagagaccaatttgccttatgtatttgttctctcagagcccctggtcaattggatggtgcccgccaacactgagggcaggtcttccccacatagtctacttggactgactaatctttcctggaaacacccttacagacacatgcaaaataatgctttactgtgtgttgttacttaattatttaaaagaagtatagcactctagtacttttttttttttttttgagacagagtcttggctctgtcacccaggctggagtgcagtggcatggtcttgactcactacaactctacctctcaggttcaagcagttctcctgcctcagcctcccgcgtagctgggactacaggtgcgccaccacacccagctaatttttgtatttttagtagagacagggtttcaccacgttgaccaggctggtcacgaactcctgacctcaagtgatctgccggcctcggcctcccaaagtgctaggattacaggcatgaaccaccacatgcagcctagcctcataacaatcttatataaataagatctttacaaaagaaaacaagttagaaagctaactttaataattatcttacatgatcatttatagagtcttgtcagggctggaattagaaccgtgatctgttgacctctaatttagttttcttttcattctatggtcctgggagaaaatttgtctttataagtatttgacatatgagttggtgtgatagattacatttcctgttcctaatgcactttttctcattaaatgaagggaactcaaaaaataaaagctttaataagactgaatttcattctaggagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaaggtaagtgtgatcacagttaaaattataaagtgcatgtatctacacagacagaaccacttgtttggtgggcacacacatttgtgtttccacagttggataatccagagaattgtctaaatctttgtcctccaaatccagtcagttagatttggttgaagaaggggataggttacataccatttacatttttgccttgacaactgtaaatctttaactcctctgacttctctgatataaatgggttgtgtgtttaagaggatcagctgaagtgttaatataccaaatatatattgggacgggacatctttggttagtcttggttaccttaaagagaagagcgtgaggtttctcttcagttgtattgtgtcctgaagatcacccaagcagctgttttttccgcctctagccatactttttgttgacaaacaacagcatgaaagttgtaaagattgctaatttagaagttaaattgttctataatatatttaagaacaagagctagatattagagaggttgtataaagaattctgaagatggttttctaaatttaaatgggtggtttgcaggttacctagtacaggcctagtcataataagtggatttattttctcttttctgtccactttgtcagtaggatttttctcttttttttcttttttcttttttttgtgggggagacacagtcttgctttgtcactcaggctggagtgcagtgttgtgatctcagctcagtgcaacctccgcctcccaggctcaagcaattcttgtgcctcagcctccaagtagctgggattgcaggcatgtgctaccacacccagctaatttttctatttttagtaaagaccggttttgaccatgttgtccagactggtcttgaactcctggcctcaagtgatttgcctgccttagcctcccaaagtgctggaattagaagcatgagccacaatacccagcccagtcaataggattttaataaaacatttaggtagactcacattagaaggattatattaactacatgtcattcatttaagttaatttgagctcttttgttctggaaagatcattggaagcagtagtttacaaatagccatattagctaaagatggaagtaattgtgatgtggaaaataaaggtctggttatttagttttgttaattttgtaatttgttgtgcattgcttttgaatactccataacacttttaaagaataaagttgcatctgattgcctgatttttgcttatatagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaaggtaccgcaaactttcagagctctgaaaatctcttgaagatcagatgtatttatcttcagacatgtttcggattttgcccttgggtttctttttttttgcttttaatgaattacttaagagcctcatggatcatatgtatttttatcatctgtggtgtctggcacactgcctgatacataggtcatgcttaatagatgtttgaatataaacagaccctaaccgctttgtgtagcaaaagaaaactagtctgctgttttagaagagcatataaaaccagtaaactgagtactaaataagcaccataattcaggtacccaagcaagagttaaaagtaattcaatgtattaaagtcagttttctgtaggacatttaagctggctaataaaagtggttaatacttacatagtacctcttttttccttttttcttttttttttaaatggagatagtctcactctgtcacataggctggagtgcagtggcgcggtcacaactcactgcaacctccacctcccaggttcaagcgattcttgtgcctcagcctcctgagtagctggaactataggtgcatgcaccacaccacgctaatattttgtacttttagtagagacagcgtttccccatgttgaccaggctaatctcgaactcctgacctcaagtgatcctcctgcctcggcctccataagtgctaggattacaggcataaacctggccacttacatagtactttctatgttcaaaatctgttctaagcattttttgtacatttactcatttgatcttcatacctaccctagaagacagggattatatgttatagttgaggaaactgaggcatggagaagtgaagggatttgcccaagagttcataaaactcaggagttcatttgtaagcaagtattgagaacatgctattaaacaatgttttttacctttgttcaaaaacaagaaaaaccctaagagtttaatcatataattcattttttgagaatttaattttgaaaatattccatggcaatattgtgaaatatgtctgactattattttaacctaaatcttaagctgtaggaaagggtttaaatttaatgatcttgagtcttttagtaatattttttaaggttttttccccaccttgaaatggagtcttgctgtgttgcccaggctggagtgcagtggtatgatcttgactcactgcaacctccacctctcaggttcaagcagttcccctgcgtcagcctcctgagtagcttggactgggactacaggcgtgcgccactacacccagctaatttttgtatttttagtagagatggggtttcaccatgttgggcagactggccttgaactcctgacctcaggtgactcacccgccttagcctcccaaagtgctgggattacaggtgtgagccactgcgtctggcctagtaatgtttaggttatatagattttatcttaaaattgatatttgctaactgaattatgtacgcatgcatcctaaatagaaaagaaaggctttatgtaaaatagttttttctaagttgtatgttaatattgttactaatttctgaagtaatgattgtttatcttcagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgggaacacatgccatatctaatttgtctgcttaagtctgtgtcactgttgtacatctatatgaccaagagcaaactgaagtaaatacagaaattttgaagtttgctatcccatgggaagacagtttattgttttcagggtgggaattgatcacttttatgtaaagcacctaaaattaatttgtattctgttcctttttctttctgcaatatttttttaatttggttctttagcaatataaataacatggttacttaccagaattgacctgacaattgagtctttatggcaaatttgccattttgaaatataaaataaatggagctgtacagatttgtgtagagaattctgtataggaaatttagggaacaagataccaggggcaaactgatttttcattgttttattttttaatttgatttgatttgtgagatagggtctcactctcttgcccaggctgtagtgcagtggtgtcatcacgactcattgcaacctccacctcctgggctatcctcccatctctacctcctgagtagccaggaccattggcagttgccacaatgctgggcttattttttgtagagatgggatctcaccacgttgcccaggctggttaaactcctgggctcaagcaatcttcctcggccttacaaagggctggaattacagacaggagccaccgcgcccagctgatttttcagtgtttaatgtttaaactttaggtgcccagttaataaaaatcaagggattttggcaattctgtaaatgcttttttcccccttcatttttcccattccacctgtaaatgatttttgacttgttaatgtatatgaaaagagaacttcaggttgctttcctagttaattttggaaattgcttaaactaaaggtttttctcctcaggtgcagagaatgtagaaagagtgttggttactgttatccaaggagcagttgaatatccagatccaattgcacagaaaacatgttttatcatcctctcaaagttggtagaactctggggtaagataattttatttcttaaccttcatttcccaaactctttcataaaactcttagacataatggaacatagccctaacagagagagaaactgggagttggttttccctggtgatgaattaattgacttacttttatatataagatgaaaatttgaattctcttgacaggaggtaaagatggaccagtgggatttgctgattttgtttataagcacattgtccccgcatgtttcctagcacctttaaaacaaacctttgacctggcagatgcacaaacagtattggtaagcacctaggaatctttgtttaccttgtgtagctcatatattcccaatttcttctttaatgccaggttgattatattatgtttcattgattttttttttaacttagtgatttcagatcagggttctttttttaaagatttatgataccttctggagtttttatgaattcttattgaatcccaatgctactgctgaattttacaaattctactccttcgactttaacacctgactttttctaggaccatgaaagggcatatgtcacaaacattctttcaagcttgagtattagtttcctactactactttaattctaaaacttgtacctagtggttttccctaatcattaagagcatgaaatggcaacttgatcctccttgtatgatagtttccccaaatctaattttcacaatacttaatgtcaatttccgctttctcactttcccacaacctggtaaaagctagatttcataattgtaatttactacgttaaaacaacagtttgtatttttctgttttttttctttttttacttcaacccacttagtccatctgcctgttacctttccttcctctatcccttctctggagttaaatatttctctggaaatatttatttgaatttccctggcagtggccagggtagtaaagagaagagctggatcactaaacaagaattgaatatatagaaattcttaaacttgtttttcacaggctttatctgagtgtgcagtgacactgaaaacaattcatctcaaacgggtaagccttttagtccatgccccttcattttcatctcacatgtggtattattatcttgttcttgaaagatgtatcttgtgtaaaatttaacttttgttttgactttttggatgtggggaaaggggatgaatgaaagtagcagtatccatttattgtccttcatgttttgggtaacatgttttggtttgactaaggatgtgaaaaatcttagccagaatttcaagattcagttttcatgatcttgtaggcttcttcactaccagattttttattttatttttatttttatttatttttttgagactgagtttcacttttgttgcccaggctggagtgcagtggcatgatctcggctcacggcgacccctgcctcccagattcaagcaattctcctgcctcagcctcctgagtagctggaattacaggcacccgccaccatgcccggctgatttttatattgttagtagaaacagggtttcaccatgttggccagggtggtctcgaactcctaacctcaagtgatccgcctgccttgcttggcctcccaaagtgctgggattacaggcgtgagccactgcgcctggcctattttttatttatttacagggtctcactctgtcactcaggttggaatgcagtggtgcaatctggggtcactgcagcctccacctcctggagtctcaactgatcctcccatctcaatctccagagtagctgggaccacacagatgcatgctaccacacctggctaatttttatattttttgtagagatgggatttcaccatgttggccaggctggtattgaactcctgacctcaagttgatctgcccacgatggcatccaaaagtgctgagataataggcgtgagccactgtgcccggccttggttatttttttaatatatattttactttattttttgtggtaggttctccctgtgttacccaggctggagtgcagtggcatgatctcagctcattgcagaccccacctcccaggctcaagtactcttcccacttcagcctcctgaatagctgggagtacaggcgcacgccaccacacctggctaatttttgtggtttttatagagaccaggtctcaccattgtccctacactggtcttgaactcctgggctcaaacattcctcctgccttggcttcccaaaatgctggtattacaccatgcccagctgattctgggtatttgtaaataactggaattggttgccaacatttaaaaatctcaaatacttttttttaaccaaaaattcttccctccagcctctctcaaagccatagaatgccagcacaggactgttattgccacatagctacagccagctaaagagcagtagttgccctcaccccctaaaaagaacatgagcttttgctcagtggtctccattcagctgtgcactcatttgaacttgattttttgattctgatagagacttgaagtgttttcaattcagcagcatttcttctatacttgctacctgctagggtggggtaggtgtgtgtttagggacagcaggggaactgtataaaggtaaataaggcatcccccgatactcgagaactcagaatcaagggagaccaacacataaaaaactccagtgggttaagtactttagtggagatacataaaatattgtggaactaaagctgaatgggcaattttgcctgaggggcaatctaagcaagctataggaaagaggtgatatttttgatggcccttaaatgtagattgatgggagtaatagggagctggcattctgggcaaagttaagtaggtgtacaaagacagattagattagatgtcacatggtggatttggtgggaagttatagacttaattctgtttagctaaagtatagaggcagaagtgatagctaaaaaataagatgagactagataaaagccttgtgttacatgtgtaaagtcaggaagtcagtaggcagtgggtttgtaatttaggagggaaagtgttcggaacaatgggtctgaagcagttaggattaaatactgattttggagtcctcagtgtaagtcagtcaaagtaaagccataggaatgactgagactttctaagaccagaacagaaagaactttggctcaagcaagagtcaacagaaaggtagaagtagaaccagatagtcaggtgtggtggtgcacgcctgtaatcccaactacttggcaggctgaggcacaagaattgcttgaacccaggaagtgaggttgcagtgagctgagatcgtggcactgcactccagcctgggcaacagagcgagactctgtctcaaaaaacaaaaacaaaacaaaatgaaaaagcagaaccagaggtaggagcattatgaaagataagagaagacagtctcaagagaggagattggatggcgttgtttggatgctaaacagtcaaggtggatgtggatgaaggatgaaaggaaacagtaaggatggtatttctacttcagaagtatttgttttatccatagaagtcgtaatttaaacatacagaattgagtcaaacaatattttaaagtgttttgcttcagaaaacaaaaaaaagttttgcttcattgttcttttttctcatcttttgactgacttgaggtataagtttactttccctgattcaaaacaaacaaaactacactcttttaaagtgataacagtgaggttacaaagtgatgaacattgcataggaagcaagtacagacagggtagacataagaaaaagatgagaaggaaagtaggagggatctgggaaacagtgaagggttactgcctctcagttacagacaggtttcctctgatgggtcattaaactgggacttagatccaaggtgaaggaggaaacataaatcctttgattcagaagcactaatattaaacaggaattccaggtggtagtgcaaggaagagtacatcgaggagagatacattgatttttttttttttttttgagacagagtctcgctctgtcacccaggctggagtgcactggcataatctcggctcactgcagcctgcgcctgccagtttcaagtgattctcctacctcagcctcccgagtagctgggattacaggcatgcgccatgatgcccagctaatttttttgtatttttggtagaaacagggtttcaccatgttggccacactggtctcgaactcttgacctcaagtgatcacccatctcctcctcccaaagtgctgggattacaggcatgagccactgcacccggccaagaaccttatttttcagatggagaaactgaggcttagagaggttaagtaacttgcccaagtgcagcaaaccaccagggcacatgtatacctatgtaacaaaactgcatgttctgcacatgtaacccagaacttaaagtataattttaaagaaggtgccagagccaggcttcaaaccaaggcagtctggctctcgggtctgtgttcttaagcacaatactatattgcctttaaagtgtacatgtattgttccgattctttttaagcttattaatgtcaagcaagaaaatagttgtaagtatcttttaatcttcagggcccagaatgtgttcagtatcttcaacaagaatacctgccctccttgcaagtagctccagaaataattcaggtaagagctatttcttaccattgtgtaggcgagagatcacagtagtagcagcattgcctgtgacattgtcgctagcagaaatcaaaaatattttcatattacataagttgttgccagcatctcaaaatactgtttatgcttatcaccattttgaaattatgagttactaagtaatatcactacaccttgttacccaacaagttaataagtccttactgttctagcatactttagtttgataaccattattcagtataattggcttctatcgtaatcccatgtattatgttttatgcatttttttaaaaaaacattctaaaggagcctaataggcttttccagactgctgaaggggaccacagcagagttctgaagctttgtaccaggtagttcattgtgtgtacaccaagcttatcaatgcttaatctgtaaatctgaaactattttaaggaaagtgtctggaaagttaccttatacttttaagaagtcatttgtataatattgtttcttggcatataattttccagatttcttgtccagtagtacatggagttaatgaagtatcaaacttgattaaaactagaattacaatctcttatgtagattccaaaatttgtttcttcatcaatagtgtttttattttattgtaagaacacttacatgagatatataccatcttaacaatttttacgtgcacaacacagtattattaattatagggacagtgatgtgcctataaaatataggtggatctccagaacatattcatcttgcataactaagactttatacccactgattagcaattcccatttcccacagcccccatctcctagaaactaccattctactctctgattctgtgaatttgactactttagatacctaatataagtggaatcatgcagttatctctctttttgtgactggctgtttcacacaatgtcctttaggttcatccatgttgttacatatggcaggatttcgcaattttttaaggctgaataacatgccactgtatgtatatatcacattttctttatgcattaatccactgatagattcattggggctattttcacattgtaagtgctacagttaacatgggaatgctaatatgtctttgagatgctgattccaattcttttagataaatacccagaagtgggattgctggattatatggtagtcctatttttaattttttgaagaaacatcttactattttctatagtggctatacaccattttgcatttccatcagttgtgtagcagggttccagtttttccacaatgtcaccaacacttgctgtctttcatttttttgtaatagccattctaacaggtgtgaggtgatatctcattgtggttttgatttgcatttcccttatgattagtgatgtttgttttttcatacacctgttaaccatttgtatttggagaagtctattcaagtctttaccccattttctaatcaagttattaagttttttgctattgaattagaggagtttttttatatgttagaaattaaccccttatcagataaatggtttgcaaatattttctcccattctttagctattccagaggttgcctttctgctctgttgattgcttactttatggtgcagaagcttcttaattcaatgtagccccactaatgtagcttttcgtgatatcaatgaaatcatttcaaagaccagcatcttgaagcttttctcctatgttttcttctagttttgcagtttggagacttacatataaagtctttaatacattgagttgatttttgtgtaagataagggtctcgttttcttttgcacgtagatatccagttttaccagcaccattattggagagattattgttccccattgtgtattcttagtacccttgttgaagatcagttgactgtatacaggagttgattttcaaattctattttgttccattggtttatatgtctgtcttaaaagagagagggtctcactctgttgtccagactcaagtgcagtggcaccatcatagttcacagcaactacaaacgcctggactcaaagaatccttctgcctctgcctcccaagtagctaggatatatgtctgtcttttgctagtaccatactgttttcacactgtaatattaaaatatattttgaaatctggaagtgtggtacatccagctttgctctttctctggattgttttggctattcagggccttttgtgattccatgtaaattctagttttgttttttctatttctataaaatatgctcttggaactcttatacggattgccttgaatctgtacgtcactttgttttttatttttggaatgattaagaagctttttaaaattttttaaatttatttttattttttttgagatggagtctcgctttagtgcccaggctggagtgcagaggcacgatcttggctcattgcatgcaacctccgcctcccaggttcaagtgattctggtggctcagcttcctgagtagctgggattacaggcaggcaccaccatgcctagctaatttttgtttttgcttttttttttagtagagaccaggctggtctcaaactcctaacctcagtgatcttcccaccttggcctcctaaagtcccaggattacgggcgtgagccaccttgcctggccattaagaagcattttgttgacctgatggaacagggatattcatttagcagctcagttttatatactctttcccctgtgtcattttacataatgtgtaaagtgggggggggacccttttattgcaaagacatttccagagtcgtcatctttttctttctttttgagacagtcttgctctgtcacccaggctggagtgcaatggcacaatctctgctcactgtaacctccacctcccgggttcaagcaattctccgggttcaagcagttctccggcctcagcctcccaagtagttaggattacaggtgcccaccaccatgcctaatttttgtatttttagtagagacggggtcaccacattggccaggctggtcttgaactcctgacctcaagttatccactggcctcggcctcccaaagtgctgggattacaggcgtgagccaccacacctgtccagaaccaggggcttttctgtgaccaaggtaaccccatatcaattaccctagcccatagtgtccttggaccttactgctaggcactggctttcagtgttgctttgtacttccctgtcgtctcctaatgccattaggcctggatagggcacctgccctttaacttcacaggtagattcccatcagaactactttgaaggccaaaatgagctgggtgagagagctgctttttctcctgctctcctttcttgtgtcctcattcttccccacgatttttttgatgtgttccataatctccttattcatcttgatttctatatccaccaggacctgctcttcataatataaatagaattgtaggaagggtaatggtattgtgttcttaaacatcatgatctgcatccaagggttttttgtttgtttgagatggagtcttgctctagtcttgctctgtcacccaggctagagtgcagtggcgcgatctcggctcattgcaacctctgcctcccgggttcaagcgattctcctgcctcagcctcccgagtagctgggattacaggcacccgccactgcacctagctaatttttgtatttttagtagagacagggtttcaccatcttggccaggctagtcttgaactcctgacctcgtgatccacccacctcggcttcccaaagtgctgggattacaggcgtgagccaccgtgcccgatccaagggttttttttgtttttggatttgaggtatgttgaaaaatacaaatttcctgccactgtcacccagctccccatgtgtgttataattcactcttatgaccttcaccaagtccctgaacactactacatcaccctggtctgggtattgcagaagggtaagggccccttcataggtggtggcagtcaaacaccaaagagaggtaagagaacagcagacatcacttctcggcagattgctttgggtagcaaagacattttaacaatattaagtcttcagtccatgaacacagctttcaatggtgtttttttgttttttatttttattttgagacagggtcatccactgtcgcccaggctagtgtgcagtggtgcgatcttggctcaccgcaacctctgcctcccgggtttaagcaattcttccacctcaacctcccaagtagctgggactacaggcgcatgccaccacacctggctagtttttgtatttttggcagagatggggttccaccatgttggctaggctggtcttgaactccagacctcaagtgatccggccactttgacctcccaaagtgctgggattacaggcatgagccactgtgcccagcctcaatggtgtttttttgaagtttttataatgctgtttttttcaaaaataaagatttcacatgagtttaaaaaatgaatttaactcatttttaatgaatttgtgatctcttatttcacagtataccacctttagagatattaatgactttcttggttatcatttgatatgtaaataaactcatattttaatgaaaataataaattactattcttgtgatcttagtgctcatcaaaagtagaacttagaccattcagtttacagctaatcttccagattgctaaatgaaataaaattatttttctatttagtaattcattatgaaagataaggaacctcagttttccctttttcatatgccttatgtctgacaacacattttgcacaatattctctattagaattttcttttcttttggtctagctctgtttggttatccctcttactagatgtgagcagccgtagcaatgtagtttttgtcccattcactcctctcaggcatgaatccaccttgtctaggagagctatgttctcaaaagtgaaagcagcctgtttgacaagtactgacatttgaaaatgctataaacctcttgtggtgagatactgtttgaattaatcttgataagttaaataccatgaatttgaagcaaccttaaattcctttgacagataaatggataaacaaaatatggtatatacatacaatagaatattaagcctgatttataaaataatcctgtcatatgctataatgtggatgaacctagaggacattatgctaaatgaaataaggcagttattaaaagacaatgctctatgattccatttgtttgagatatctaaagtagactcaccaaagcagaaagtggtggttgccaggggctggagtaggggaaaatggggagttcttcagttaagaggcaaaaagcaagcttgttttgcaagatgcaaaagttctagaaacctgttgtacaacagtgtgcatgtagttaatgcttactgtactgtacatgtaaaagtggttaaggtgataagttttaagtgtttttaactacagcttttttaaaaaaagagctgggcacagtgacttatgcctgtaattccagcttcttgggaggctgaggtgggagtgtcccttgagcctaggagttggaggctacagtgagctatgatcacaccactgtactccagcctagatgacagagcaagaccatctcttaaaaaaaaaaaaaaaattaaaaaaaaaaaactggatacgaattacaatggatttaatacaaatacatttgttctttttctccctcttttccccaccccccaggagttttgtcaagcgcttcagcagcctgatgctaaagtttttaaaaattacttaaaggtaggtatttgtgaagctcacgtatcttcatacaattaggtaatgtttgagagccaagagagaatacatacctgcaattatagatgtttatgtgaagtcccttttaactaagctcttgaaaaagagtataagttaggtaagcacactgaatgtgtacacctttgagtatattggtgagaaaatgccagttttcttttacagtttcatgatgtaattaaatagaaactagagggattaggagaataagaaatgttcaagaacagttgtccaaattaagttgaaaagaaggggctaaaaatataaaaacagaaggatgagatatttgcttatatcctattttgaaacatttgaactgtaaaacagacaaaaaggagaatcctcagatttgggccatcaagcctccttttacatttacgaaattactgatttttttttttaactctgtaaatcaacaaaaagtgtcacgtgtttatttggtattcatagttataattgagttcatgagatgaaactgtcttggtcttacctaggtagtcattcatttcatacataatgactgctttttatgtaccaagtactacagtaatggctgcaaatacaactatgagtaattttccctccccataaggagctcatgatctagaaataaagttacagtgtgacaaggtgaattattttttattatcttcactcaaataatttgaagacaaagcactgtattaaattcagtagcaggtaacttagtgtatcacctggttcttttagcaaagacattcagtagaatttgtaagtcagagggctttgcgcagtaaataatttaagtgtgccatcctttgactgtggttctaacatcttcccttgtcagttttttcttagttgtagtttgtcagcttaaacatctcagagtttttgtggaagaatattgagggcttgtttttgtttatcattgggaaccctccccttcgccatcctcccataaaaaagcaaagtgcctacaggagtaacccctgttaaataactgatcagtcaaactgaatttaaggactcagtcctcactatctgttagaggtgtctgtaacagtagatctaggtaccctatagaaggcttgttctccagatgtggttatttatctgcatagcatttataaaaagtcttccttctgggcccaacttctcttcagtgatgacattatcttagtgatcataattctcagtgttagcattattattctagttggaaaaaatgaatttcattcgtgttcactcctcccttcacatctgattgatcctcagatcttgcagattctttcctcatcttctctctcttctgtctctgctgctctggtgtaggctgatgttatcttactctgatctctcttctcttgttctagccaggctgatgtgtttgaaaacttcaagcagtcctttgatatttattcaccttcctcataaccttcctgaacaaattcatgtttctcagtttggcacttaattttttttttttttcatattctgccctgagactacctttctgttttttcttgcagaaatggtctttactgttcttgtagttcttcaaaaatcctgccttactagcagcccaacttctgtatgaactgtacccatttctctaggtttgccttaagcacagcctccttgtaaggttttcttttgcctatatagtgatcattctttcccctgcacatagtagattatctattaaatgaatctcctaggtactagggcactatcaatactgttcttgtctgtattagtccattttcacgctgctgataaagacatacccgagactgggcaatttacaaaatagctttattggatttacagttccacatggcaggggaggcttcacaatcatgtcggaaggcaaggaggagcaggtcacatcttacgtggatggcagcaggcaaagagagagcttgtgcagggagactcccatttttaaaaccatcagatcttgtgagacccatttactatcaggaaaacaacatgggaaagacctgcccccatgattcaatcatctcccacccggtccttcccacaacacataggaattatgggagctacaagatgagatctgcgtggggacacagggtcaaaccatatcattgtccttactgagaacactgaattatgtctggtgctcacctgacctgccatggatggcagcatgtagtactaggccatgcctagcacagcctctagccaactcctttgtagtctcaaattttgacttggaagtacttttgaatcatcaaataaatagtaaattccttacagagttagaactgctatgtttagctttgacttgtttcctcctcaatatttaatttttttttttttgagacggagtttcactgttgttgcccaggctggagtgcagtggcacgatctcggctcaccacaacctctgcctcccaggttcaagtgattctcctgcctcagcctcccgaatagctgggattacaggcatgcaccaccacacccggctaattttttctattttgagtaaagactgggtttctccatgttggtcaggctgatctcaaactcctggcttcaggcctcggcctcccaaagtgctgggattacaggcgccgtgcccgtcctcaatatttaatttaccagtgttaatttggaaatagtaccaatcagtaaaaaggtgtcaagagcttgttttcttctgaccacttgatttctatagcatagagataacaccatattttcactacttccccagttgggtgatgtcagcataagttatatctacacttaccaaactctccagaacagaaagttcttagcttggattacatacggatatataaggcatgcgaaatgttctaatgttacagaagaacattgctagcactcagatacttggagccattcttcaggtgaaagtgatatcttctgacattagtattgattgcattaatactttatttacaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatcttccaagtcttttctggaattattataaatactttagttttattttctcatcttaatctctccataatttcccatttaaaggtttacaaatatgagtgtgtggatgctttaattcatttaacctcactcctcaaaggtaacatgcaacttagttctgttatatgagagtctttttctttaatgtactggaaaaagcctatgtgaatctgttgatagaatttaaaattccaggccgggcgtggtggctcacgactgtaatcccagaactttgggaggccaaggcaggtggatcacttgaggtcaggagttcgagactagcctggccaacatggtgaaaccccatctctactaaaaatacaacagccaggtgtgatggtgcacgctcgtaatcccggctactcaggaggctgaggcaggagaatcgcttgaacccggaaggcagaggttgcagtgagctgagattgtgccactgcacgccagcctgggcaagagagtaagactctctctcaaaaaaaaaaaaaaagaatttaaaatcccaatttattttctaactcttttattggatgtatttagaacacagtatacctatagtatacctatgtgtttattatgtttgtaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttcttttttttttttgaatagagatcagtctatcacccaggctggagtgcagtggtgacatcatagctcactgtaacttctcccatactctaccaatcctcctgcctcagcatccagactagctgtgattacaggtgtgcaccaccacacccagctacatttttttttggtagagacagggtctcactatgttacccagtctggtctcaaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttacaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaagaattcattagagtggacttttgttatctccattgtgcatttgataaaactgaggcttagagaggtaagagattagcttttaagtcagtaattggcagccgagacagcaaccctaggtctgttacattcaaaagcctctgagccactccgcatgacttcccattcattcgtgtttgctgctgctactctgggaaacaccatcttcctcttcccctccactcagaaatttagccctagattagcagcggtctctgctccctcatgttgagaaaggcctgttgtgctgtccgtgggcagaagggaccccttcagaaagctattccttattgggaatagcggcttgagattttgactgcacgaatattgcaggacctaattttagtatttaagttttagttcttaaattcttaagtttagagttagatactccaatacggccgttttccaaaataccgagagggaattaaatgaacatttttacattaagaatttaatgtatttctgggtgatgggaaaatgaaaaaaacaatgtaaagtctgaattactgcgagacgataatctggctccactgcagccaaagtgggcccttaaaacatagaatccatccctcccagctctgccggccgtctgtgcctgccccccacgtgtcccacgttctgcacacctgtaaatcttgggatgtaatcccttgctcagcgtcggtccgccctactgtcggccagcgctcggggaaggggcgggatttgcagttgcgggaatcccaattactgtgttcgctgctcagggctcctcattcccctttagagtaaagggcgagggcaacagtggacggggtgtctccagacatccccctcattaccgtggccgcggaagccgactcggcagttgccgccgcggctgtggtgactaccagacgggccataggcgtgcgcacgcgcacccgcaccggcgcgccggccgtcggtcacgtggcctccggccagggcttgcgaagccggaagtgtcctgagtctcgaggaggccgcgggagcccgccggcggtggcgcggcggagacccggctgggtaagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctggggtgtgtgtcgggtggccgtagccggtggaatggtcgcgcgggccctgttacctgcatccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaatgtattgatttttcagaggattaaaaagagacgtttccttagagttttagtgatgttcagtccgcagaggttgactcacaccggaaattagaagcataagatgttttaaatatatgccgatgaaatacgaattcccagacatttccttgctcctcgtctacctggcttatgggtttaatttgtaatctctatcccaagtattcttagtaggtggcctcaaaacaactcccaagtaattgccaaatgtataaccaaagactggtcttttccactctgaaaccccagtgtatgaatcacataggggcagagtttagaaatcctggaactttgtccataggccatgtcgtcaaacctgttttcatccctcaacaaatagtaactttcgttttggacggtgtaaggaagtaggctgaagacggcatcatcagcaacatagttgttgagtgtctgcttatatgcttgtcaaaaatttgggaagatttatatggcaagcacgttgtgggtgtgctgagtcatgttttaacatgttattgtggagttattggaagataatttcaaaagacatttcccctgaccactattgtgattactgttaaatagaaaccatagttttgtatttgcatagagaacagatatcttagctgataaatatttttcttattatcctgaaggtacatacatataggtacctaatggtactatttgccatttacagttacattgattagggaaggtttttcgttagatagttgagacgtttgttattgtatcgtgagtgaaatgtaatgactggcaaatgtgtattccttatttgtgaaaagggaatcttatttttattgcttatttcctatagtcgtatataaagtttatctaaattagatgggtagtaaaattatataaaaatatcctactatatcagtgattggtaaaattgagacccctgaccattctgcattttcctaacccagcttggggatattggtggtcattaattcatcacagaatacctagtctagcatactactttttgctttaacttactgtggagggatattaaaatccatgttttaatgacaatacagcaggtttaagggggcatggtgggactagtgtttatgttatgttagcatacatcaattttagtccagtgtggagcttggatactttgtataccttgatagatccatagcttttcagtattaaagacttgataatacaggctacttggtacgtttatatatttatacttggaggttggagaaactatccttaaattaattccagaagagttcgtaacttttcaggaataataatttttgcacctttcctttatgtttgtcaggttctgtgtagattgtgtagataaaattttagcttatgggaatattatgcagtgacaacatttgtcttcattagtgtttctctgctctgaaggaaacaaagtaatttttcctatatttgttatattttacattattacttttctttattttaaaacaccttaaattatgtcataaattaatctttcaaaacatttgaaggaggtaagtaacaatatcactctcatcaacaaagacaaaattagaagagaaataggtgttgtttttgtttgtttttgtttctttttgagatggagtctcgctctgtcaccctggctggagtgcagtggtgcgatctcagctcactgcaacctctgcctcctggtttcaagcaattcttctgcctcagcctcccgagtagctgggattacaggcatgcgccaccacgcctggctaatttttttgtatttttagtagaggcggggtttctccatattggccaggctggtctcgaactcctgaccttgtgatccgcccgcctcggcctcccagagtgctgggattacaggcatgggccactgcacccggctgagaaatagatgtttctttcagccctgtgttaagtgaattaaattgaatgtatgtcattggttaatgttttttttttcaaagctcatacagcattttagccttgaatattgctagaaactcagatcttttttttttttttttttttttgagacggagtctcgctgtgtcacccagcctggagtgcagtggcgcgatctcggctcactgcaagctccgcctcccgggttcccgccattctcctgcgtcagcctcccgagtagctgggtctacaggcgcccgccaccatgcccggctaatttttttgtatttttagtagagacggggtttcaccatgttatccaggatggtctcaatctcctgacctcgtgatccgcccgcctcggcctcccaaagtgctgggattacaggcgtgagccaccgcgcccggccaattttttttttttcttttttttttttttgcgatggagtcttgctctgtcacccaggctggaatagggtggcacgatttcagctcactgcagcctctgcttccgggttgaagttattctcctgttgcagcctcccgagtagctgggatacaggcacctgccaccatacctggctaatttttgtattttttgtggagacggggttttgccgtgttagccaaggtggtctcaaactcctggcttcaggtgatctgcctgcctcggcctccaaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaactttgaagaccttttatcactgtatgta

SEQ ID NO: 379 - DNA, 503332 bp, Homo sapiens
aagaaacatatagccctatttctagcatcatgtggtagaaacatacagtcccttaccattatatccagggacaaccctaaagatatttataaaaaagaaatcaaggtcctattatttttaactgatcttatctggataataatagattaagaaaacaaagataaagaaagtaaataattgcacacagtttattgcctctgtatcagataaatgatctgttcctatcttgctgtataatgcaacgataagtgaaacttaaaaacttcaaacaagcatttgaaagcatttaattccagatatcttctgataaaataatgactaaaggtgttggaaagaataccaaactagaaatcaagagaatgagtttccagtcctgtgtaggcctccaaggtttaagtactcagattatatatctgtaaaataagaggtctagacaagatgatatatggtataccttccagctttaaaattttaccaaactaagtactcaattatatcaaaagaacagcattcatagattttaaggtaaattgaaaatattaatttattggataacatcatagctttattgtttgtgatcacacattaactgaaaaagcttttgtctgattgctgcaataatatataggaaaagcctcttagtaatattagacaacaataacgataaagcatttcctctgaattcaccatttggaaatacttttcttattctttgacaaatagggatgactttccaagttagactgaacttgacctttgggcttcaaaaataaagctactttacatgtgaaagctcatttttatatgatggtgatatcatctgaatgtttgtgcccctcaaattcatatgttgaaacttaatcatcgatgtgatgatggggcctttgggaggtgattaggtcatgaaggcaggaatggaattaaagcccttacaaaagaaaccccagagagcttccctgccctttccacttgtgaagacacagcatgatgatgtcatctatgaaccaggaaatgagccctcatcagacatcaaatctgccagtcccttgagcttggacttcccagtctccagaaatgtgagaaataaacttcagtcatttataagtcactcggtctatggtattttgttacagcagcccaaacagactaagacaattggtatgaattaaaccttttcttactgcgaatcacaattcacatactttattataagaaataatcggtattacattgaaaaagtttctaaaataacatctttttattggctattccctaaaaataaatcaagagaattctgcagacctttatacattggactacagatttgttaagagaagaaaaaatcatagtgtattttcattttctttcttgggagggataatctgctcactataaaaagaaaattatgaatcactgatttagattagggttctcaaaacgtattccccagacctgcagcagcaacatcacctggaaacttgttagaaatgtaaattcttgggccctattccaaatcaagtgcatcataaattctggggatggcccagtaatctgtgttttagcaagtctttcagcaattctgatgtacctaacgtttagttaatactttattttactggtctactttataagacatatatacttatttctgcacatatcaagtagtaactgaatgggtaagaaagataatttaaaatataaagtcgaatcttagaatgttactggccaaacttacgaaattaacctactcttgctttctgagttattagctttacttatcttgcttagtttcccacatgtcacactgaaatgctcactagctccagatttggtcaatttaacatctactttgtcattttttttcaacaatcttatgctcaaactgcaactaggagtatagtatataatttttaggtttccttacaatctcttaaagattagccaaattttaaaatagaaaaatatgcaaactttaaaaattgaatctgttcatccaacaacaatcatcagttacctattatcaaatctcttacaggctaaggagagaataatgaataaaagaaatttaaaaaaaaaaaccactctcagagagcttccattttttgggatgttacattgtatttggtttggtattccttttcaaaaaaaagggtacctctaacatttgtacaagttactcttctgtttttctacttttatgttgctaataaatagtaccaaggtgcatgcagatatataatattaaaataataatttgtgcatgaattatttcagaaaagtataatgaattattttaaattctcttaatgaactgtaagctgtaagcaaatgtaaaattactagtaatagacacagacaatatttttaaatgagaataaatccaagtatttgtaaataacatcctactcatgatttacagatacagtttcattagttataaaacattttagaaatatataaacaggaccggcgtggtggctcacgcctgtaatcccaacctaggtgggtggatcacctgaggtcaggagtttgagaccagcctggccaacatggtgaaaccccatctctactaaaaatagaaaaattagctgggcgtggtggagcacgcctgtagtcccagctactcaggaggctgaggcaggagaatcacttgaacccaggaggcagaggttgtagtgagccaagatcgcaccactgcactgcaccctggatgactagagcgaaactccgtctaaaaaaaaaaaaaaaaaaaaaaaattccatatttataaatacagacatacactacataataacatttcagtcaatgacgtactgcatatatgacagtggtcccatatgataatggagctgaaaaattcctattgccttcttacattatagctgtcataatgtcacagcacaattaatttttaaataaatttagtgtagcctgggctgggggtggtggctcacacttgtaaatcccagcactctgggaggctgaggtgggcggatcgcttgagtccaggagttcgagacaagcctagacaacatggtgaaaccctgtctctactaaaaatacaaaaattaaccaggcatggtgatgcatgcctgtagtcccagctacttgggaggctgaggcaggaggatagcttgagccctggaagtcgaggctgcagtgagctgagatcatgccactgcactccagcctagatgacaaagtgagaccctgcctttacaataatctcctgtatcttatgagatattctgtttcttaaacatctcatttagatgctttaattttattcaaccaaggttttagaactcattagctctaaaacaatcatacagacctcagttgggttttctctcagcattgatgttcatttactgttactattaatcatctgatacattatagacatgcctgtgtatctgtctagatatatttaggaatataggtatctaccatttacttaatgcttgctatgtgtcaggaaggtgttaaccattttatactatacatatatgtgtgtgcacatatacacacacacatacacatatattcataactaccccatttagtatttatcatgccttagtttccttaactataaactaaaataactgttatttttaagttacacagtttagcagaatagagatgtaagcaagtctgcttttctcccacgtctatgctcttcttaatcactagacttacattataagccctcatggaaccatgggaacacaaacctgcttggttcactgcttgtcactttccttaaaattatgccaaaaaaaaagggtcttaaagacttggcatttctttattaataatgaagacacctgaagaagatcaacaaagtacttttcttcatactaatttctcactcacaatttgttgaggccaccaaacaagcaagctacatgggaaattgaaattagaccaaggtggcagcatacatgtaccacatacacatatatgtatatattaacatacatacatatgtacacattaacatttctgtccatttggttactgaagttggtatttagggtgcaggaaattactaaaatgatagaagaaagttactgtggaaaggctgtgaagaggccaagtgcagtggctcatgcctgtaatctcagcactttgggaggtcaaggagggaggatcacctgagcccaggagtttgagaccaacctgggcaacaaagtgagacccctatctctacaaaaaaattaaaaaaatcagctaggtgtggtggtgtgcatctgcagtcccagctactcaggaggctgaggtaggaggactgcttgaacccaggaggtcaaggctgcagtgagccgtgatgatgttgctactgcactccagcctgggttacagagtgagattctgtctcaaaaagaaaaaaaaaaaaaaaaggctgtgaagaaatcttgagtactaaaattaaatgagaaagaggatagccagatatcagtaattaactgcttattttactaaaataccgaggcttatctaattccaaagtcaatccaaatattctaggagaagttcgcgtacatgcatatgagcatttggtttatggggaagaagataaggatataataagagaaaggataatgaagaagcatagtagaaaacatccctggctgggcgcggtggctcacgcctgtaatcccagcactttcggaggccgaggtgggtggatcacctgaggtcaggagttcgagaccagcctggccaacgtggtgaagccctgtctctactaataatacaaaaaaaattagccggcatggtggcgcacacctgtaatcccagctactcgggaagctgaggcaggagaatcacttgaacctgggaggcggaggttgcagtgagctgagatcgcaccactgaactccagcctgggtgacaagggtgaaactccatctcaaaaaaaaaaaaaaaaaaagaaagaaaaagaaaagagaaatatccctgcgttagcacgttagcatataattctaattgtgatacataaggaaatgtagacagttgattaggggactctaaaacttatcaaaaagcattttcaatggctaaatagaaagtagcaaatagaatcttcagaaacaaatggaaaactctgagcttaaggataaatgagtaaaggggaatcacttccagaacagtgaagcagtgaaatgggctcctccaacaatgcaagaacactgggattaactgtcaaaatcaactttatcagaactctgaaaactaactaaaggcttgcaataatctcaggagtgtgattttaagaataacagccaaataacagtaaaaacagcaagctttgtggaattttaattttctctattcttatcatccccttgccaactccgtggtatccttacaagtcaacaatctcacaactatggctgctgtgaaaactagcagcctagcagttactagacagggcagaatgggtctggagcacctctaaaacccaatcgcaaagaaatgtcactttatgacctgtgtagcagctccctgaaaagctccattcccagagctcatctttccttttttttttttttttgagacccagagtctcactctgttgcccagactggagcgcagtggtgcaatctcggctcactgcaacctctgcctaccgggttcaagtgatcctcctgcctcagcctcccaagtagctgggattacagatgcccaccaccatgtcccagggctcatctttttaagatgtgactcacagcatgctgtgaatgattatatccctagggcatttgtcaaaagcaattaatggtaactgtttaacactgcacctgccttaggtggtgatatgagttaggactagagaaattaatttccagtttgccacattatataatctcaaatatcctcttatcaaaaaattacgaaacatgcaaggaaagaggaaagtatgtctccatatggaggcaaaatagttaacagaattgcttctgagaaagcccagatgttggacttactagacaaatattttaaatactattataagtatgttcaaagacctaaaggaaaccttgtctaaagaattaagagaaagtatacatgtacctcaccaaacaaacaaacaaaaaatcaatatagagatataattttaaaaaacaagtgaaattctgcagttgaaaagaacaatattcactagagggactcaatagtaggtataaactggcagaagaatcagtaaacttgaagataagtaaattgagatgatttagtctgaggaacagaaggaaaatagaatgaacaaaaatgaacagagcctcagagaattataggatgccatcaaatgtaccaacatatgcataacaggactcccagaagaagagtcagagaaaggggaaaaatgaccccaaacttcccaaagttgatggaaaacattaatctgcacattgacaagctaaatcaactccaagtagaatagattaaaaaagatccatatctagacaaatcatggtcaaatgactgaaggccaaagataggatctcaaaagcaacaagaataaaaaactcatcacacagaagtgattctcaataagattaacagtagatatctcataaaaaaatgtgaaggccagaagttagcgggatgatgcttttgatattgtgttgaaagcagactcaaccaagagttcaaaccatccagcaaaacactcctttaaaaaaagaaaaaaggaaggggccaggtgccgtggctcacgcctgtaatcccagaactttgggaggctgaggcgggtggatcatgaggtcaggagttcaagaccagcctgaccaacacggtgaaaccctgtatctactaaaaatacaaaaaaattagctgggcgtggtggcacatgcctgtaatctcagctactgaggaggctgaggcaggcgaattgcctgaacctgggaggtggaggttgcggtaagctgagatcgcaccgtgcactccatcctgggcgacagagcgagactctgtctcaaaaaacaaaaaccaaaacaaaaacaaacaaaaaaaaaaggaaggataagcagtgtcctgggttactgaaaaaataaattaaaaaaaggtgaaataaatacattgcaagataactgataattcagagagtttgttgcttgtggacctgcccttcaagaaaaacagaagtccttcggactgaaatgaaagagcactgacagtaactaaaatccatttaaagaaataaagaacactgataaaggtaactacacaaaatataaaaaccagtacatatatatacatacatacatatatatatatatatatatatatatatatatatatatgtttttgtttgtaattcttttctctccatctaattaaaaaaaactttgtaaagaaatagttataaaaataagttggtgggcttaaaatgtataaagatgtaatttgtataaaaccagcacaaaggaggcagaagggaaatgaactatcttggagcaaagtttttatatactactgaaattaacttggtattaatccaaactagattgttttgagatgttaattgtaattctaagggcaaacactgaaaaaactcaagaaaatatactaaagggaaaagaaaattaaaattatatagtaaaaaaatactaatttaatgcccaaaagtgagtaacggtgaaacaaaggaaaaacaacaacgataatatatcagacatataaaactccaaaaccaaattgtagacatcatcctatcttatcagtaatttcactaagtgtaaatagattaaacactccaaataaaaagcagagattatcagaatggataaaataaataatccaattacaagctatgtacaagaacacttcagatttaaggatacaagactgttgaaaaatggaaaaagacataccatgcaaatggaaatcaaaagagaactggagtggctattctaatatcaggcaaaatagactttaagacaaaaactcactcactagagacaaagaaggacattgtataataataaaagggtcaaccaatcaggaagacttaaaaagtataaacatataagtacatgatacagtctcaaaataaagatcaacataaaaatagaagatttaatcaatgctgtaatagatgtctataggatgcttcacttaacaaaagcagaatacatattcttgtccacagaacattctctaggagacaatatgttaggcccccaaataaaacttatttaaataaataaattttaaaaacctgaaagcacagaaagtatgttctccaaccatgataaactgaaaaagaaatcattcacagaaaatttcataatgtatggaacgtaaacaacatactccaaataaccactgggtccaaaaataaaaccccagggaaattacaagagaataaatgaaaagaaaaacacgataccaatatgtatggggtgtagaaaaagcagtaatttgatgaaattttatagctgtaaatgtttttattaagagaaaaagatatcaagtgaatatttttactctgtaccttaaaattgttaaataaaaattaaacccaaaggaagcagagggaaaaaaatttagagtggaaataaataaaacaacaaatagaaaaagagtagagaaaattagtgaaataaaaattggttcttcgaaagatcaagaaaattgacagagcttcaaatagactggccagggtagaaaaaacaaaaggtaagatccaaattaataaaatcaggaatgaaagaagaagtatcattaactactttagggaaatgaaatggattataaggaaatgaactatcaattgtatgttaacaaatcaaatagcttatatgaaagggacaaaaaaatcctagaaagatgcaacttaaaactgactgaagaagagagaaaatgtgaataggccaataaagagattaaaccagcaatcaaaacactgcccagaatgcatcattggtgaattgtaccaaatgtttaaacaaataccaatccttcacaaacttccctaaaataagatagaaatgaacattttctaattcattccatgggatcggtattaccatgatcccaaaaccagacaagaaaattacagatcaatgtcccttatgaatactgatgcaaaaccctcaaaaatataccaataaacagaatcaacatatgaaaaagattatattatacatcataacaagtgggatttgtcaagggaatgacaggttggcttaacatatgaaaatctaccaatgtaacagaccatattaatagtattaaaggtaagatccacagaacaaactcagtagatatggaaaatcatttaataaaatttaacatcatttcctaagaaaaacactcaacaaaagtaagaacacaaggaaatgtcctcaacctgataatatataataacctgatatatagcctataaaggctatatataggctacacacacacacatacataacagcatagctaatttcataattaatggtaaaagactgacagtttaccttctaagattaggaaaaagacagggacattcataccacttcaacattgtactggaggttctaactggaaaaattaggcaagaaaaaaaaaaggcacccggatcggaaaggagaagtaaaactatctctattagtagagtatgcagacaatctcaaagaactgatccccccaacaaaatctgaaaaaaaacaaaccccagaaaaacctgttagaatatacagattcaaaaaggtctcaggatacatgagcaatatacaaaaaaccacttgtctttctatacccaagcaacaaacatctttacctgagtaatgaacaatctgaacataacaccaattccatttgcaatggcatacaaataaatttaacaaaaaaaatgctgaaaaccacaaaacaccattgaaaaaatttaaacagacctaaataaatggacccatgctaaaagactgggaagacttaatgttttcacaatttaatctatgaattcaatgcaattcccataaaaaattttgcaaaggctgagaaggtgatcataagattcctatggaaatgcaagggatctaaaataaccaaaacaatctcgaaaaagaacaaggttgaaggacacaccctgattttaaaacttctacagatacagtaattaaaaccgtgtaatgctgaccatagaataggcgtgtgtatggatcaatgcaaaaaaattcagactctaaatataaactcttacatttttggtcacctgattttcaacaagggtgccaagaccattaaaaggaaaaaaaaaaaacaccaaaaaacaaactaacaaaaaacccccacttttttcaacaacagctaaatgcgaaagaataaagttggatccttaactcacaccatctacaaaaataaagtcaaactggattacagaccttaaaggtaacagctaaatatataaagccctcataagaaaatctgagagtcaatcttcagatcaggcaatggtttcttagatataacatcataggtataagtgacaaaataaaaaagtaaactaaactttatcaaaatctaaaaaattttgtgtgtcaaaggatatgatcaagaaagagaaaagacaacctacagaatggaagaaaatatttgcaaatcatatacagtcaaccttcggtacccttggaggattggttccaggattccccttggacaacaaaatctgtggatgttcaagtcccttatataaaatagtatttgcatacaacttacacaatcctcccatacactttaatctccagatttataatacctaatacaatgtaaatgctatacaaatagttgttatactatttttattttcaaattgttattttttttcaaatgttttccatttgtagttggctgaatctgtgaatgcagaacctacagacacggagggctaaatgtatctagtaagagacgtgtatccagactatacaaataactcttacaagtcaataataaacaggttaacttaattagctacaaataatataaatatatttacattaaaaatttatatatattttacaaaattttacaatttatttttatatactatataggtatatttatatactatatgcctggtacatattaagtactcaataagagttaggtataattattattaaattcctaagttatttgactattaacaaggaatgatgttttctgcagaatgcctatagctatgtgaccatattttccaaaccaaatatagatttgttaacttcaaaccctccctccctcccttcctccctcccttcctttcttccttccttcttccctccctctctcttccttcctttccttttctttctttttctttctctctctttctttccttttctttctttcccttcctttctcctttcctttctctctctctctctttctttttagaattacaggagaatccataaagtgaaagcaagtttattaggaaagtaaaggaataaagaatggctactccacaggcagagcaagcctacttcaactccatttctgaaaaccaaaaattatttctcagtttattgaaataagctctgattcacacacacacacacacacacacacacacagtatattaaaaaaatctagtatacataattatataacaaaacataattataatctccccaattagaaaatgagcaaagaatttgaattagacatttctccaaagaaaacatacaaatgtcatttcagaagatgctcacattatcgtcactgggaaatgcaaatgaaaatcatgaggtgtcacttcctatccactaggacagctataatacaaaatcagtaacaagttacgatgtggggacactgcaacactcattcatgtctggtgtgatcgtaaagtggttcagttgctttggaaaacattttgacagttcctcagaaggttaaacagagttaccatatgatgcggcaattctactcctaaatatatacacccaagagaatggaaaacttacgtccatgcaaaaacctgtacatgaatgctcacagagtaatattcatggtagctaaaaatggaaacaacccaaatgtccatcagtgaattaatggataaaaaatgtagcatatccatatacttgataatatttttggtcatcaaaaggaatgaaattctgatacatgccacaacatggatgaaccttgaaaacattacggtaagtgaaaaaagacagacacaaaaggctacacagtgcgtttatataaaatatccagaataggcaaacccatagagatggaaagttgattagtagttgttaggggtgaagaaatggaaaggatcattgctaatgagtacgggatttcttctgggggggcaacgaatgttttaaaattagatagaggtgatggctgcaaaactataaatatattaaaacccactgaatggtacactttaaaagggtgcattttatgccatgtgaattatatccaaataaagctgttataaaaaaagaacatcatggaaatgattgttaaaggaagtgtagttggttatgatgaagaaagaaacagtgcaagaaaaaatacacgtaaggagaccatatttctccatgtcagagaagacaaccttgattctggccatggaaatggacaaaagaggtgagactgtggaaatataatcaaaggagaaagcaacatctgtgggatataagagaactagctaagcttaacatattacaccaaagtattgctcataagaccaaacagctggtagtaccaatgacagaaaactaaagtggaaaggcccagtgaaggtcctggggaagacaggagttttactgagctgtgcttatttttatttttatttatttatttattttttgagacggagtctcactttgttgcccaggctggagtgcagtggcgcgatcttggctcactgcaagctccacctcccgggttcacgccattttcctgcctcaccctcccgagtagctgggactacaggtgctcgccaccatgcccggctaattttttttatttttatttttagtagagacggggtctcagtgtgttagccaggctggtctcgatctcctgacctcgtgatctgcccacctcggcatcccaaagtgctgggattacaggcgtgagccatcatgcctggccaagctgtgcttatttttaggttctttaaattaccaagtggtaacagtctaagtatggattataaagattttttttctagtaaaagagaaagaaaagaattaagattagaatatgagctggacagtcattcatgcttgaacatgagctgaaacttaagtgtatacagtgagcttaccaagtaggtctcaaggaagagatgaagcagccccatcacctcattcttgggggatacaaacaatcacctcctcattccttcactccttttcttcaagcagctgtctgtggcatgtgggtagcctagtttgaagtatagcaggtgtttgtaatttcctttctcaaggtcacaggtgactctgccagtgcacttcaaaaaccacagcttctgggcccctttcttcccaccaaaccccaagatccccttctcacatccagattactctgttacttacacatctttaacccactccacagctattagaattgaagtgcccctcttcccaggaaattgactaaggttctatccactagcctcagatcgttatctgtttgaaacttctttgtgggctgatggaatgttttccaagaaatgttttagaaattggctttcttagataatttccatggtggatttattaagaaggaggaaatcaaggtcatctgttctttttagctgccattctggtcagcctttccagtggtgcctgttgtctccaaccttcattatcacattccctgcctaatcccattgaaagttacagttatattacaaagatcagatgagataatatatagtatgtagcagggcttttaaaaatatacattgtttcatacatgttaactgctgttaatactacctaaactgctctcaattttcacaaaatttgccttgtgccactgaatgacattagagtttaatggtttattcagataaactgattctgcttttagagagttaatatttttggctcatttatcataatgaattaacatattaaatctaaatggttctagaagacgcttgaagaccttttttctgttttccctttggcaaacggtgatgataataataatttatctcatagaattattatgacattcaagtgagattatctgctttgcacagtgcatagtaggtgcccaataaatgttaggtacaattattattcaattcctgaagttcttcaaattatcatagaggaaaggtgttttgtagcgaaatatttctgtagaacacccacagctataaatgtgatcatattttctaaatcaaatgcagatcgactaactggaattcctctgctgaaaaccaggatttattttcagatttggtaaaataagctctgaagccaaaaagtactcccagagaagtctgcatatgttgccataagatagtgccagccagagagattctgacaagaaaactttatgaagtttgatttaaactacagaataagaagggttttttccccctctacggatttattttacttaatctttatgcatctagctaatctgtgacccaattatgtagttataccaagggtgtctgtgttagtgacggccgtgtggctatctctgtcaaagactaatctcactgctggggacactgagatgacaggatagagtatcacaagaagatgaaacttggtgaactcacatgtttatcacggtaaaaaaacaatctatggaacattagtagtggcagatggtagatgtccatctaggcaggaaaaccagggtactagcagtttgataacctttgattaaatttctccccaaatggaaagtaatgctccataataatgtgtgttaaattttttcttttccaaataattgtttccttcatttcatagcctgttaactcaaggtttgcttcctgctagtgactatattactgcttccttagagtggttaaattttattttccttttggtaaaggaaaattttaagtaaccactatatcttattttaaaggcatgcagtaaatgctttgttaaagcacaataaacactgaaattactattaagtagtaacactcctcatgcaaaattacttaaaaataaaaacttaaattgcctgcaggaaaaaaaattgttgccattttgattttgtgcactgtttaacatttttctcatgtttttgaataaagaaaacttgtatgaggcattataaaactcgttaatgctacaaagtttggaaggcagctattaacacagttgaaaaaatcaagattcaaaagaattttgacaagcagggtagcgagtcaaaaatgaatctatgaaattcagtaaaaagaaatggacaacattgcagttagggttaaatagtaatagctaatggccgagagattactgtgtgttagacacagtatttagtacttgaaacaatagaataatattaataaggcagacactattatcatcttctttccagatataaggatggtatgaggcacaaatatataaataatgagaagacttgtctcaacaacatatctttaaaacatcaaggagttatgttcaataacaaacaaaatatccagataatagaaaccaataatacctagtcttgaactcctgggctcaagtgatccttctgcctcagcctccagagtggctgggacaacaggtgcgtggcactgcacctagctaatttaaaaaaaatgtttttaagagatgggttcttgctatgttgtccaggccagtcttgaactcttggcctcaagcgatcctcccgcctcagcctctcaaagtgctggcaggcatgcgccaccacacctgccccttttcttatattagaaaaaatagtgagaatttatgaaatgaagaaaaaagattactgggtgttcattcaatagaacactaggcagcctgaccagtgccctccctctttcacgctatatactacacgtgttctccaacccatctgctggctaaattgcacagatatctggatcccacatcccactgcttagcattgtttatcaagcactgagtttatgaaggtggagagactgggccctatagtgaagagacttagattctgatctactgacaacaactaacctatgcccacttattaagcggcatgaagttttcaacaaaaatggtggtgggtgttaactgccacattataacataaggaagtgaattctaactgaatcctaagaataaataaaatgataagtgagcattcaaaggatcaccactagagatgtgcttcatttttctgctctaatatattgtctttgagcaataagagcagctgaaaaagatgcatagaactttagacccaaaagttgactttaagatcaattttttcaacttttgtcattctagcaattagaaaagtaagtcccttggcaagagaccttgccacaactgacctactctactcctttgtcaaatgctaaaacccagtttgcatctttctcctgcctcattcatattgctggatctttccttccatctgagaaatatttattttgaatggaatactgttgtataattacccaaactgtacttttcactttcacagaacaaggaaaaagaaatctttatttcacattctatataggtttatctcatggcagtccttttggcaaaatgctttcttttctgaaataagtcagtaacatatccacagggctaaattaattgctattctattttccatctcctctcatgacaagcctcttcaattgcttctgattcatcatgcctcctagtgtgaccatccagcttcctttctgggccctgttctcattctcccagagacagcataaaaacacactccatttccatacttgcattggtttccgagatgctacattatccctgatctcctgcctccctttctaccatttgtcttctttgagggctcttcttccagctttcaaaatatgaacatacatctaggccggctctctgttcttacttattcttacagtttcatcatatatacatttattcatttaagcagtatctactgaaggcctataagtagtggtgagtaagatggacatagtccatgctgttatggaacttacatccagttaaggaagaccagataagaaaataaataaaaaattccaaattgggataactgctaaggaaaaaaaagaaagtgtaataataaagactaatgggggtgaaggaaggtcttttgaaaagttaacatttacctgggatctcaagaaaaggcctattatgcaaaaggttgtgtatattcaggggcagagagatcaaatgttcgaaggtctttgggtgagtgggagaaaggttggttgtgttcaagaaactcagaacagagagtaccataggatgatgctgaagagacagacagacagcagatcatgcaaagccctataggccctaggaaagggtttgggttttatcctaaacataaggagaagttactgagggtgtaaagcaggaggttatcccattctgacttatagatcactttggctatcatgacttacagaactgatgaataaggtgatcatatatttagggttgcccgagatagtcccagttcatgcctattgtcctggcataactgaacttctgcattgatttcagggaagagtcacaatatgcaataaacaaatacatacataaataaaacaaaaaacaaaaaaaacaaaaaaaaaaaaagaaagaaaattgactaagacacaaacaagctgtgggaggcaacattcatcaggtttccttgttcctgatctccttgacctaactgggatccttccttgggtgctccctttgattcttgaactagttttacttctcaagcttgaaatatgttcttgtccttaatatctggctatctcctgtaattaaataatattcagcagctggtatacacaaatatatcgagtgaggtcctatttgcataaactcattcctcataacattccatgaagtaggtattatccccatttacagatgagcaaactgaagcacagagaggtaaagaaacgtgactaaagacaaacacagccaaagaatcaggacttgacaccaggtaatttggttctggaatcagtgttctttacttctaacattgcttctcaatgtgagaaaccgtaggcatatttaggaactgcaaatagctcagagcggccagagtgagtactgggacaaactggaggtaagtttagaaaagtagcagaagggtttcaaatgacatgcaaaacaactaagttttcatctgacaggtgatggggtacaccacaggatcttaaatacatgatcatatttgtgctttggataaacagctctgtggaataggtggaatagaaggtgggtaggaggagaatggttcctgactcagctttttctaaagactggacctgcgcctccttcctggatggggcctttggatatccattgtgaagaacctgcatgcaattataatacatgacttcccacaacctaggcctgggccttccaatgatgggatctccctttttaactacaacttttcctttgagtccctttcatcagctctcatctccaagtctttttataagcatacctctatttccacactgatcccgatagtctccttatttaaatccttatcaccacaaatgtagatttctgtagcttcacagctcagttaccttcttcctaacgccaccacctgcaatttcatgagctgcttttattttaatccttttaaaacattactcccttcatcatattattctcatgatcaaataccttactattgcttatacagatagtcttaactgttaacctaacattcaatgatctttataaatgatgcccaaatcacattttccaatcttctactatctcatctacgctgctgcagtcaaattttctacccatctataaactgtgtgtacacagtgtgtctttctataatctttggtcacactgttactctggtctagcaaaacgcattcttttaaaaatcccatcctttcatgatctggtttagcacttgccgactctaaacagccttcctaaaccactccagtgctgggaattcctacagcactcaaagccttacaccatattcctatatttgggcacaaactgcctcagtaacatgacatcccttccgttattgctctgaattttttattcatttcatatattaggatttagctgtttacaggtcacttttctaatgacatcaagaactactcaaagacacattgtgtgtgtatatatatatacacacacacacacacacacacacaatatatatacacacacatatatatatgtgtgtgtatacatatatctaaagacctataaaaccatgttttgtgggttttttttttttttggtatttctacttttcccatagtatttccatacctcaccagtgctaggtatggtactatcctatgtatattgtatacctcatgtttcttgataatttagaaaattcaatttatgctgctgttatatcttccagtaatataaaattttcagaattttaagagtttttcaggtagaaaaatttagcaaaaccaaaagagaaatggaggaaaaaaagtctaagaaaaacataaatgccagtggagtatgctaatgggaaaaaaatcaacataagcttcacaatttacaatgtctggagaaataaactgatgtgcttatacttaaacatgttatattacggaagactacaagtggttgttaaagagaacctattttgcatttatatttgaatttcgatagaactgctttgaattgctactttattgataagggaaaacaagttcttttatgacaagttataaaagcttatagtttatcagttccctctccaccctgcaattacctacaggaagagattggccatgggttctattttatgagttttataggggcccattcaccccagtttacatactatgaattcttggaaaatgcaatagattgtagaaaataaagtgcttcctttgaataaaggacatttcacttaaactcatacatgtatctacatacaagctgtcccaaatattatgttaaaatatgaaacagccatattttacatgaatatatgtataaagtatacaaaagtataatactgcaataggtagcaatcttgtcaatctacagaattggctaaacaatgataacaatctaacaacaataacaacccaacagctattgagtaagtacagatattatataatccaagagattcaggataaaatttaatttatatgattcagatcagtacatttatgaataagtttagtgttaatggcaaacaatattacaaacatctcagaaatatttcagaataacaaaataagactaacgcatattaaagtttactactgatgaaataccatgtgacaaaaattcattcagcccttagaaaactttgaagaaaggtaactgcagaaggaataaattaatagcttttaaaattggtcttataaatatgaagaataatgaatcaacatttaaatttccaatcaggttagaatgctttaaattctaataattaaaggaatacttaagacacatggcaagcgtttcatagttggtataatcctgatgagacagtctgaattttatttcaacctgttgtgatagatgtgtaggcctctgtgaaaatgcaagctgtaattttatatactgcccaaaatccatttgctaaaagaagctttgttctctctaccggggttacagggtcactgaataaaaactaaaaatattaatattagtgttacaagtttggaatgtaggagctttacaaaaatttaagttattcattcgaataggccatattgatgtcatttgaattttatcatattagttttcactggaagagattcaaaaacagtactcaagacactagaaattatatattcagtatggcttatcatgtttcaatgtattttacatgtatattaattctgccagaaaatatgaaaagctatgggatttgccaagcatatgactgtacactgaaaggtagatatgttttaactatgttccagggggaatacttccttatgctagttgccatttccctttgatttgcaaataagtccttcatttaaagtaaatacaggactcaaacttgtgctgacttaacaattaactaacttttacacctgccttttagggttcagacaataacctctgattaatctgggctgatattatccttaacttactataggcgataagcaagtgcagagggactaattcttaaagtggcatgatgtaagtcttttcatataatctaacatcatgattatctcatgtcttatttactttttctattatcaatagtacagtgtctgaatgaatatcattcaggacaaaaattagtgaaaagaaagccacacatttaaccatcaaatctgacctaggacattaggtataaagaaaataaaacaatatctataatatacgagcaggccacataggttccttacacaagagaatgactagcagtctgatgtccaatgtctcttctgcaatactaaacgccagaatgcaaagataatcaacttccacaatgttttgaggagaaaaggttaagttcaagtaattaaaaatcttggcaagctgtctaatagtaaaggcaattgacaagtatttaaaaatatgcagactcagataattcacttcccattttctaattcttgaagaacaactagaaaatgtactctgaggtataaacaaaatgaagagctcagcatgccaaaaaaattaagtgattatagacagttaaaaatagaggtttgattctttttgacgaaaggggtgtcacatcatgtggagatttttttcactttctattaaaggtatctcaaaaaaacaaatatggtactatttgtaagaaagaaaaaaaaaacccaaacaaaaaaatcaaagttcatgtagtaaatgaaaaacaaaaaggaaacaagtgaattaaaaagagagtgagaggtgacatggaacaaagggacagaggtggttttgttctcaggctgatctttatttactgaagggacactggattgtattatagtactatagaatcaaactcaagtttgattgaccataaccatatatttactgaaaacttcacttagaattccaacttggaatgttaagaaacatatcggctgggcgcggtggctcatgcctgtaatcccagcactttgggaggctgaggtgggcagatcacgaggtcaggagtttgaggccagcctgacctacacggtgaaaccccatctctactaaaaatacaaaaattagctgggcgtggttgtggacgcctgtaatcccagctacttaggaggctgaggcaggagaactgcttgaacccgggagacggacattgcagtgaactgagattgcgccacggcactccagcctgggcaacagagcgagactctgtctcaaaaaaacaaacaaacaaacaaacaaacatatctttcccttgaaaagaggtctgataaattctcatttgctcacttccctcacccatttaatggctgcaactagcatataccactctcctagaactgccattcatggcagtacttggagcaaggggaacgtgggcatgaaaatgggtaaagaagtaagctgggaattgagggttaggtctggggtcgagaagtcactcagggtcccagcctcagctattctaaaatcctggcccactccctttctgtttttttctcaggctctaacagatacttaaatcatggtatctcttctttttttgggtcagtagaatacaaaatttggggctacaaatattccactttgataatttttagactcctttttttcctccctaaacattttcttctcctaagccctttaaagaaaataagagaagataggttcaaggatggaaattagataaaattacatttctgtgaaaatcagactttacttgtcctggtctgggaccagagggcactgggcaataataatgaacagacttatgattctatttagaggttatggagaaagggcaaagattaagtgttggaaagccaggggctgttggggagagaggtagtaacatccttactttgtagtagagacacagaaggagaagagtagccaatccttcctcagaaaaatacatcaaaaaggactgaatatattattcaaatacattaaaataataaatttttcttaattgccattctttaattttttaatactaaagaataaaatttatatcatgttatggctactcttttagcatacttactaaaggataactgaaacatacatactacagtcaagttctttttaatgattatgctaattcctcatgtactggtcttttctaaagtcccacatattaagttatcaaacatgttaaatcaatcatagggatttattacaaataaaaaatagagtcaatttgctactgaggcatatattaatcatcaacacaattcaaatactttaatattacctttatttatttatttttgagatggagtcttgctctgatgccaggctgaagtgcagtggtgcaatctcggctcacagcaaccttcacctcctgggttcaagcgattcccctgcctcagcctcccgagtagctgggactacaggcatgcaccaccatgcccagataactttttgtattttagtagagatggggtttcaccatgttggccaggatggtctcaatctcctgaccttgtgatctgcccgccttggcctcccaaagtgctgggattacaggcgtgagccactgtgtccggccatctttattttcttaattggtacagtttgactatccctaatccaaaaacctgaaatatgaaatcctccaaaatctgaaactttatgaacattgacatgactttcaaagaaaatgttcattgggacattttggatttctaatttttggctcagggatgcaggaagtgtaacacaaatgttccaaaatttgaaaaagaccaaaatccaaaacacttctggtcctaagcattttggataagggatactcaacctatattaccaaatctttctcacaataggaaatggagaatcacaggaagtacttggaagacttatgaatgcaaaggataagaaataagagtaggattagggaatgtacagtgtactctatatcatcttatgagtctttcaattgcaaactagcaactaatatatgtttcacacaaatatcatattcagagactaaaagggaaatctaataattatcttccttctattaatacaactttttaaatatagtgaatagatgctataattgttaaatgccttttgttgagaagaaggataaaagataagacttcagttctataataataaagcaaagtaacctataagagaaatgaagcataatggccttttttcactattataaaacattcactttaaataatgatgctagtgcacaaaataacattcatttttagaagggtaaaaatcaatttgcacaaatacttacattacattatcaaaactataaattatttctaagttaacaacattaatatgaacaaatcttgcagggatataacttttggcaaaaaggttttaagagttttctacaatggcactgtaactataaccagtataattttgtactttcttaacacttttaacaacgtagcaacagactgtcttaccgttggtgctgtatctacctgatggttacaaggctttctttctatgctgataatccctgtggaaagaaaacattgtgagtatttggttattaagcctgtccattttatgttgaaaatattcatgccattttattggaaaaacatttattatgactcacacagcttccaagaaaaaagtctcacttggaaggcaagatccttttaagatgtatcatgaattctttggtcagaaacagttggtctaaactgactcaaggttagctaagccttttttcccattcaagtgatgtctagcaatagcgcaagatgtgtccacatcctgctctcaactcaaaaattacaccattatctgggctctgctgcttttcttccatgaaagttttatttctgattcaaggatatgaagtttttaaaaagaagtatcacaagggctatgaagtgaatcactactgtcttattttctcaaaagaataaataaatccatctgaatttctctttgatcatctgacttcctactatgacatactctatttattcaatcaccatgagtatctgaagaaaaatgttcccctgattccctcctttaaaatgataacacagatggctaatcttgagaaatattcttttatcatgtgtggatttatctttttgttcccaatgttctctactgcatttctttgtaataaacaccctttcaggacgtgacacaggggatctcatctgtaaagatactggttcaaagtctaactcaagttaaaaatgaacacaagtgtgggtcttgtttaattcctaatttctggccaccagcaaactaacatataatttaggatattaacatagtttgttcaaacaatgctaaaggctgtcatatgcaggacaagaggcaagaactacaatgtctgttaatagcaattagtaaaattcctagtttaaatgttagtttctcttctacaagcatatgactcatttttcttaaagtacggtaaaggattaagtgagatcaacacaaacaatcactttttatcgctttgcaagagtattttcaaaatgaatcatgaaacatgcagtttttgtttcattaattttttgtaacatttattgttagccagtgaagtataaagcactatactaccttcattcaattgactaatatttttgagtggttattcttggtactcagtgataaaagatgaatatattacagtttctgactataagagtctagtaaaacatggatatccttttctgaagaattaccacagagcaaatgaacagagtttcatcttaagtgtaataaaatctttaaggtaattttgatggaaagacactcttattcatagagtaacaccagttttgggttaattttttttcaaagggtacaacatgcaggcaaataagtaatgtagattcctattgtaagattttaacaatatagaaatatagagagaataaattgagaaatcccaactttgtcagcccctacagtctcacaatcctagctgcaaacactgagaatagtgtggcatggcaactggctttcaaatgagagtggtcatgccagagttcagcaattaacaacatcttacacacgtcttctcactattgtaatctgactgttataaaattgacctaggctgattactgatttttaaattcttatctaaacagaaagtaattttaattggagaaaaggaactttaaaataataaaaaccaaagcaaaccaggcaaaaatctatatatacagtttatacaataccaagaaaaaaacaaaaaaaactctacagattttagtgtttccattttaggataagaatgtgttgaaaattagaatttcaaaaactggattatccaaagttataatcttagttttaaatttagattacatatataaataatatttggaaatacaatcatgcatgtttgttcaagcttgcagtaaaaaatatatagaaaggaataaactttagaaaaaaatgtatcaaaataacttcctattttaggtaaattttacttaaaaatctgtatttgtatctcatttcacttttattaatgtataacaataattgaaagctcataataagtagcatgctataatggttagtattatatgtctacttagctaggccatggtacccagatacttgatcaaacattattctagatatttctttgaaggttttagatggaattaacatttaaatcaacaggctttgagtaaagcacactgccctccatgatgttaagtgggcctcatccaatcagatgaaggccttaagaaaatgacaactcacctgagagcgaggggattctgccaacaggctgccttcagactggaactgcaactctttcctacgtctccctcctgttggcctagcctgcagattttggtcttgccagcccccacaatgtttgagacaattccttaaagtaaatctttctctctctatggtcttcctactggttctgtttctctggagaaccctgactagtaatatacttactttctgggacatatgaaataaataaaaatgctattgcttatactctaaattataaatgttatgttcattcaacataattgtgtaggaatatagttaaaatgttgatgttagtatgaaatattttaaaatctgcatatatccgaatgaactcaggaatatatagatagaataaatcgacctatcaacaaataaaaatgaaaaaaattataaaagcagtctgtcagcagaataaagaatcaatctatcaataaatattactgctaggttgtccagtctaacaatctctgcctttcaatgatttgactatttacatttaatgcaattactcatatggctttgctgaagtttagcattttgctatcttattgcatttctttttgttcttttcttcctctttttctatattcttttgcaatagtcaaatagttttactcttccattttatgtcctctgatggctttttagttacatctcttcatattttttaatggctaatgtagagattacaacgtaccactgtactataccttgaattaggatttcttctacttcaagaataatataagcaacttaaaacagtgttaaccccatttattcaaccaccctttatgcttttgctgccttatatttaacttctatatgttataaacaccacaatatattgtcagtattgttgttttaaactgatatatttatctttatcccttcttgcagatccaggctttcacatgagatcattaatcccctgttattttgtagtgtaagtctgctggtgactatgttttttcctgaaaaatctttagtagggattcatttacaaagaatgttttgctgggtattgaaatctaggttaatagccattttcttttagaaaatgatttcattccattatttcttatgagaaggaagtcatcattcttactatgatttccctgaacgtaacacttttcccctctggctgcttttgtaattttctttttagtttaatcaggaggtacctaggtatggtttcacacacacacacacacacacacacacacacacacacacacacacacacgtgtgtatatttatactctaaaggaatataaatttttcattttcttcagtttaattaggaggtatctatggtttcatttatatatatgtatacgtgtatgtgtgtatctttggattttgctaagcttttaaattttattttttttgattttattttttatttcaataggtctttgaggaacaagtggtgtttggttacatgggtaagttctttagtggtgatttatgagattttgtgtatctgtcacccaagcagtgtacactgtacccaatgtgtactcttctatccctcacccctgtcccaccctttccaagtccccaaagtccttagaataagagtctccaattctatccaggttgctgtgaatgccattattccattcctttttatgactaagtagtattccatggtgtgtgtgtgtaggtgtgagtgtgtgtatatatatatatgtataaagaaaatgtggtgtatatacacatatatatacttggtgattgatgggcatttgggatggttccgtatttttgcaattgcaaattgtgctgctatatataaacatgtgtgtgcaagtatcttttttgtacagtgacttttttttccctctgggtagatggtagcgggattgctggagcaaaagcgctacttttcttaggttggtgcaaaagtaattgcagattttgctaattgaaactaatggcaaaaactgcagtaacttttgcaccaacctaatagttctttaaggaatctccacactgttttccatagtggttgtactagttcatgttcccaccggcaatgcagggatgttcccttttcaccacatttacaccaacatctattattttttgattatggccattattgcaggagtaaggtggcatcacattgcagttttgatttgcagttccctgatcattagtgatgctgagcattttttcatatgcttgttggccatttgtatatcttcttttgacaactgtcaattgtctatgcatgtccttagcccactttgtgatgggattttttttttcttgctgatttgtttgagttccttgtagattctgtatagtagtcctttgtcagatgcatactttgagaagattttctcccactctgtgggttctctgtttactctgctgattcttttgctgtgcagaagccttttagtttaagttccatctatttatctttgtttttgttgcaattgcttttgggttcttgatcataaagtctttgcctaagccaatgtctagtagtgtttttccaatattatcttccagaatttttatgattctgggtcttagatttaagtctttcatccatcttttttttaaattttattttattttattattattattattattatttttattgatcattcttgggtgtttctcgcagagggggatttggcagggtcacaggacaatagtggagggaaggtcagtagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctccaatgtctacctctttctacacagacacggcaaccatccgatttctcaatcttttccccacctttcccccctttctattctacaaaaccgccattgtcatcatggcctgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctcccggacggggcggctggccgggcagaggcgcccctcacttcccggacggggcagctggccgggcgggggttgacccccccacctccctccgggacggggtggtggccgggcagaggggctcctcacttcccagtaggcgcggccgggcagaggcgcccctcaccccccggacggggcggctggccggacggggggctgaccccccccacctccctcccggatggggcggctggccgggcggggggctgacccccccacctccctcccggacggggcggctggccgggcagaggggctcctcacttcccagtaggggcggccgggcagaggcgcccctcacctcccggacagggcggctggccgggcggggggctgacccccccacctccctcccggacgaggtggctgccgggcggagatgctcctcacttcccagacagggtggctgctgggcggaggggctcctcacttctcagacagggcggttgccaggcagagggtctcctcacttctcagacggggcgtccgggcagagacgctcctcacatcctggacggggcggcagggcagaggtgctccccacatctcagacgatgggcggccgggcagagacgctcctcacttcccagatgtgatggcggccgggaagaggcgctcctcacttcctagatgggatggcagccgggcagagacgctcctcactttccagactgggcagccaggcagaggggctcctcacatcccagacgatgggcggccaggcggagacgctcctcacttcccagacggggtggcggccgggcagaggctgcaatctcagcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaatccccgtctccaccaaaaaaatacgaaaaccagtcaggcgtggcggcgcacgcctgcaatcgcaggcactcggcaagctgaggcaggagaatcaggcagggaggttgcagtaggccgagatggcagcagtaccgtccagcttcggcttggcatcagagggagaccgtggaaagagagggagagggagaccgtggggagaggaagaggaagagggagagggagagggagagggagagggagtgggagcgggagcgtctttcatccatcttgagttgatttttgtataaagtgagagatgaggatccagtttcattcttctacatgtggcttgccaattatcccagcaccatttgttgaacagggtgtcctttcctcactctatgttttgtttgctttgtcgaagatcagttggctgttaagtatgtgggtttatttctgggttctctattctgtttcattggtctaagatcagtactatgctctttcgatgactatagctttataatatagtttgaagttgggtaatgtgatgcctccatatttgttctttttgcttagtcttgctttcgctacatgggctctttctttggttccatattaattttaggattgttttctagttctgcgaaaaatgatggtggtattttgatggaaattgcattgaattttttattgcttttggcagtacggtcattttcacaatattggttttacccatccatgagcatgggatgtgtttccatctttttttggtgtcatctgtgatttctttcagcactgttttttacttttccttgtagagatctttcacctccttggttaggtacattcctaagtattttattttatgttttgcagctactgtaaagggggttcagttcttggtttgattctcagcttggtcactgttgctatttagcagtgctactgatttgtgtacattgattttgcatccagaaactctactgaattaatttatcagatctaggagctttttggatgagtctttagcgttttctaggtatacaatcatatcattggcaaacagtgacagtttgacttctttactgatttgaatgtcctttatttctttcccttgtgtgattgctatggctaggacttccagtattatgttgaacagaagtggtgaaagtgggcatccttgtcttgttccagttctcagggggagttctttcaacttttccctgttcagtataatgttggctgtgggtttgtcacagatggctcttattaccttaaggtatgtcccttctacatcaattttgctgagggttttaatcataaaggacgctggattttgtcaaatgctttttctcttgagatgaccacatgacttttatttttaattctgtttaagttgtgtatcacacttattgacttgcatatgttaaaccatccctgcttgatcatggtacattatctttttgatatgctactggatttggttagctagtattttgttgaggatttttgcatttatgttaatcagggatattggtctgcagttttcttttttttttgttacgtcctttcctggctttggtattacggtgatacgggattcatagaatgatttaggaaagattcccttgttctctatcttttggaatagtgtcaggaggattggtaacaattcttctttgaatgtctgatagaattcagctgtgaatccatctagtcctggacttatttttgatggcaaattttttattaccatttcaatctttgtgcttgttattggtctgttcagagtttctatttttatgctgttttatccagaaggatagtatatttccagcaatttatctatctcctctaggttttctgatttgtatgcataaaggctttcacagtagtcttgaacaatcttttgtatttctgtggtttggttgtaatatcccccatttcatttctaattgagcttatttggatcttctctcttcttttcttggttaatctcactaatggtctatcgattttgttaatcttttcaaagaaccagcttttcatttcattcatcttttgtatttttttgttgtttcatttaggtctgctctgatctttgttattttttctcttctgctgggtttgggtttggtttgttcttgtttctctagttccttgaggtgtgaccttagtttgtctgcctgtgctctttcagatgattgtaggcatttacggctatgaactttcctcttagcactgcttttgctgtatcccagcagttttgacaagttgcatcactattatcatccagttcaaagaatttttaaatttccatcttgatttcattgttgacccaatgatcatttgggatcagtttatttaacttccatgtatttacatggttttgagggttccttttggagttccttcatttatgaagcttagttcctctggatacaaaattcttggctgatgattgttttgtttaaggcggctaaagataggaccccaatcccttctagcttctaggatttctgctaagaaatctgctgttaatctgacagattttcctttataggttacctgatgcttttgcctcacagctcttaagattctttccttcatcttgactttagataacctgatgatgtgactaggtgatgatctttttgtgatgaatttcccaggtgttctttgagcttcttatatttggatgtctgtatctctagcaagaccagggacgtttccctagattattccctcaagtatgttttccaaacttttggatttctcttcttccaggaacaccaattattcttagatttggtcatttaacataataccaaacttctgagaggctttgttcattaaaaaaattttttctttgtctttgtcggcttgggtcaattagaaagccttgtctttcagctcttatgttctttcttttacttgtttgagtctattggtaagactttccagtgtattttgcatttccctaaatgtgtccttcatttccagaagttgtgattgttttttttcatgctgcttctctggagatttttccatccatatcctgtatcatttaaaaaatttctttaagttggtattcacctttctctggtgcctccttgagtagctaaataattgaccttcagaattctttttctggcaattcagagatttcttcttggtttggatccattgctggtgagctagtgtgatcttttgggggtgttaaagaaccttgttttgtcatattaccagaattgtttttctggctccttctcatttgggtagattatgtcagaggggaagatctgtggctcaaggactattgttcagattcttctgtcccacgggatgcccctgatgtggtgctctccccattcccctaaggatggggcttcctgagagctgtgatcgttgtttttcttctgggcccagccacccagcagagccaccaggctccgtgttggtactggggagtttctgcagagtctggtgatgtgatccgtcttcaggtctctcagccatggataccagcccctgcgctggtggaggtagcaggggagtgaagtggattctgtgatggtccttggttgtagttttgtttagtgtgctggttttgtgttggttggtttccagccagaaggtggtgctttcaagagaacataagctgtggtagaatagggagggtacaagcttgccctagggtcacctggataagtattcaggtttcttaggtggtgggcagggccacagagctcccaagagattatatcctttgtcttaaggtaccaggacaggtagagaaagaccatggtggtggtggggggcacccgcaggattaggtatgtctgaactcagactctctttgggcggggcttgctgcaactgctgtgtgggatgggaatgtggttctcaggctgatggagttactttcccaggaggattatggctgccactgctgtgtcatataggtcaccagggaagtgaaggaaaggcagtagttacaggcctcacccagttcccatgcatcccaaaatgccactctcgttcccactctacccctcagtagcaaagagtttatttccaggcagccagtgagcagggttgagaacttgccccaggctacaagcctcccttctgagaaagcaagcagggcttttaggttttgcaccttcccacctgctgtggattctgtgctcatatctgcactcctcatttgctccctcctttggattctgtccaggaaactttgccttcagttgaaattgttacagacttcagctagaagtttccttctccttgttgtctttcttcaattccactggcagccctccccaaggactcctgcaagacagtcaggaatgcaggaatggcttccctgaggaccaagagtgcccacagggctcttcccactgcttcctctacccctatatttcactcggctctctaaatttgtctcagctccaggtaaggtcaaatccttttctggtgatctggaccttcaggttccccagtgaggatgtgtgttcaggggtggacattccctctctcactctttgggcactaagtttttcagctgtctcacagagcatgtagcagcaagctgccccctctaacaggtctgtggattctcttggcttttctggtagtagttcttggagcaaaagttcacagtgtgattctctgtgcactgctctgtccgtccaagtgggagctgcaagttagtcctgcctcctatctgccattttgagacagcatcaacacagttatggaaacaagctttaaatgctgatgactgcttctccttgctaagctttttatgtctataggttgtctttaattagaggaaaactactagcccattatttcttcaaatatttcttcacccatattttctgttttccttctgcaattccagttgcatgtttaatccatttcacagggacacacagatatgactctttcttcttcccatgcctcctcttcatctttgtttcaatttgaataatctgtataatttttattgttttgccctccagttcagtggtcctttcttttaaggtgtcctatctgttgttatctgctgttatctgttgttaggtccatctaatgaattttcattttatctgttataatcttcaggtctagactataattcatttattttttaggatttccatttaagagaaatggaaatcctgacttccatgaaattctccatctttgcactccttttgctcatggttcctcataagttatttaacatatgtgtaacagatattttaaaattcttgcctgctaatgccaacattttgattatctgtaggattccttttattcattgttctttttctttgttatgggtcatctatttctgctaattcacatgcctcagaatttgattataggttagaactgccagacatgtaatcagtagactgaaatagcaaacgtcttccctcagaaaaggctcaccatttcctttttcagaaagctagggtgaggggtagatctcttttcaaatcaggagctgacttgggttgggactgggctgttgcttagttaatttcaatacacctattataactctccccaaaatgagatgagttattccttctagggggactttgggatttaaacttctagagattatgggaactctctctgccttactcccagtttcctgtcagtgcttaagcttcaaaagtcctcttggggagaactgataggcggagaggactgagtgacatttgggatctttcagattccaatctatcatgccagtccacatagtccttagaagttcagctaatctctccttgcctcagcagtagctctgattatagaaggcttgctcctctgtttgcctggtttctatctcaataaatgttcccatgtatttaagtgactgtttgtctttacttctttatgcagtagggttcatttctctttgcaatttattttgtttagaattctctgtgaccacatctctttgatggctttttagtttatgtgaggtcttctcaataatatggtaagagtgatgatcattacaatgtacatattaattagaagcaaaactctacttccaattatttatatggttgctttttaaaattttcttgttttcggtctatttcagtggatactccttttttttcttgcctgttgatcttgaattcttgttttcaattttaccaacacttaaaatctgctattagttcccttctggattctaacagtaataaatacatttattatttatccaaataaatttatgtctaaacctctctccaaccaagatactatacataccaatatctccttgctccacatcaagattaaacttttagaaggcttttatttctctattctttttatatagttaagtttaaagagataaaaatgcatgggaatttgtagaagtgctaagtgtgaatttatgaaacaaaatgatatagtgtaagaaaacacctaattttttcctctatgcctaacagaaaaatctaatgttttcctctgtcttgagatttctgtttcattgaattgtcatttggttacagtactctctaaatccttgtatatccaaatatgccttcctttggataagaaaccctttatcttggttgcctatatgttattccactatcagccagcttctagtgttttagatatgtcaggtgctcatgtgattttctttcctatgtaaagaacctgttcctcctctatagaagcttgtgatatttttcctttacctaggaaatcaggaatttcactagagtacggctgagtgcctttgttatcattaatcttttcccgggacttgataaaccctttgacctgcagagtcttatcattcttctgctcagggaaattttattctattatttaattttatagctcatctttaccttcacaacttttatcttcatgataatcttttcaactaatcttctatgtgaacatcctttctactctagagattttaacatttgaagtcatatagtttagtttctttcgaaagatctacaaagactaagacaagaaggctagcaaaccctggagtatatatcagaatgaagttttcctgggatctcagtgccaatatgtcaaggcaaagggttggggtgggaggactttgttctactcggtgttgagcaaggatctgtgcagggtaagcaggctttttccaaaggtgtgagtagaaaattaagttttcagagttcattgagggctttcagccagcagaagctataaatccccttggaaatgggcaatatctgtaagtttaatgtttgtagtacaataagggcctagcagatcctatgaatcataataaccctaaaaagggtctatacacctggaagaaatggtttctggaagaactggcattcagtcccagtcattgggagatggctgtaacttgcaactgatgagacttgagaagagagccttactcctgtgccccagcagaggggtatcagttgggcaggtttgattttgctacaactcagacttccatcagtatagctggggcaatagaccatgaagaggcaaagaaaataattttcttcaagagcctcagtagcctgaagaagaagaaataaactagaactggtagtgatactgatgacaatagaagaattagagagtcttttaaattaaaccaaaacaaacaaaaaacaactattaagatttcttgccaggtgcagtggctcatgtctgtaattccagcacttggggaggctgaggcagaattgtttaagcccgggagtctgagactagccctggcaacatagcgagaccctgtctctaccggaaaaaaaaagaaaaaaaaaaaagaaaaaaaaaattagctggatgtgggtgtgcatgtgtagtccagctacttgggaggatggcttgagttgagcctgggaggtcaaggcttcagtgagctatggttgcaccactgcactccagcccaggtgacagggtgagactttgtcaaatacacacaaaagtttaagttaattactaaacaacaagataaccctattttaaaggaaggaaacagtggctttcagaaagtaaattagaaggtaggtaacattcctaaggtcatataactaaaagcagcagtacctggactgacacccacacctctaagccacaaacccttcagacccatttatgtgtttgtttagcccctgtggttgggacctgatttttttcatcttcatatccacagtgcctaacccaaatgcttaaaatacagaaggtcttcaagaattgactcaaatattaactgaatgaatctattctcctatgccacattcaccagattcatatgctacaatgcagtgttaggtgtattagtcatcagaatgcctgagttaacgtactaggactgttttaaaaaacgttaatttaccctttggtaatgttcctaaacttagtgcaaaactgaaatgttttacagtcatgtgctgagtaatgatgttttagtcaatgacagatcgcatatacaatgagggtctcataagattataatactgcattttgctgtaccttttctatgtttagatacacaatttttaccattgtattacaactgcctatggcattaggtatggtcacatgctgtacaggtttgtagtgtaggaacagttggccataccatatagcttaggtgtagtaggctatactatctaggtttgtgtaagtacactctatgatatttgcataatgaaaaaaatcacctaactatgcatttcttaaaatgtatcgccactgttaagcaatgcgtgactatacttaaacatttccctaatttcccagatactaatacagtctagagaagataataaaagaaattttatgtttcttgggagacacttttagtatttattttgtagaaaatcagatcatgacattttattccattgtacctaatctgaacagctgaaagcatacattttttagttttcctaaaccctaccaacctttaactcaggactacgatcaaagaaagaagaacaaagacaaacagataggctgcaaaacaaaaacagacaggaacatgtgccaagttttgaagacagaacatatgtccagcaatcttatgtatcattaccaagtggttacaagctacttgctaagcacaaggcactgttctgggaacaggagaagctctaacctccctttcatgacatcttaagagttacttgtttcgggcaatatgatacctatgcatcctatgtcagttttggcaatccccggggatctttctatatagaacagagatagaattatggtttgattatctgtgcctatgaaaacatgagatttattacattccagtagaatacagttactgaaggcagagatcttttctgctagtttatatatacatatatatatatatatatatatatatatttttttttttttttttttttttgagatggagtcttgctctgttgcctaggctggagtgcagtggcgcaatctcggcttactgcaagctccacctccaggttcacgccattctcctgcctcagcctcccgagtagctgggactacaggtgcccgccatcacgcctggctaattttttgtatttttagtagagacggggtctcagtgtgttagccaggctggtctcgatctcctgacctcgtgatccacccgcctcagcctcccaaagtgctgggattacaggcgtgagccaccgcgctcggcccttttctgctagtttaatgtgaagaagttatctgtactgagactgcaagcctttcttaagaactggaaaagaaggtaaactatgttttgcagataatataattttatatctagtaagtccaaaagaatcaatgctaaaattaacacaatcagtaccagaactaataaactggaaagtcagcatcatataaaatttaatatacaaacgtcaatttctcttacatattcaaacaaattagaagatacaatgaaagagaatatttcacttataagggcaatataaataataatatgaataaatacaacaaaaaatgtgtaaaacagtatgaagaacaccttaaaatacttctgaaaaacacaaaagtccaggtggcccttgacttatgaaggtctgacttaacaatttttcaactttaccatactttgaaagtaacatgctttcagtggaaagcatactttgagtacccatacaactactcagtttttcactttcagtggaatattcaataaactacatgagatattcaacacttaattataaaataggctttgtcttagatgatgtggcccaactgtatgctaatgtaagtgttctgagcatgtttaaggcaggctaggctaaagtatgatgtttggtaggtttggatgcttttctgacatattatgggtttactgggctataactctattgtaagtcgaggagtatctagttggaacatcccatgttgtgtgacaagacaatgtagcatcatataaatgtgagctctccccaagacaatatataaatttaatatgattttaatttttaaaaagtttttttttccagcactagacaagttgattctgaaaatcatatagaagaacatgtaagaataccttaaaaaaatcccgaggggaaaaaaacgagcaaccactggaaataaacactactcaatattagtatatatcataaaaagcctctgtaactaaaataatgcaatattaacacgagtagccatgtagatgaacagaatagattaaaatgtttagaaaaagattcaagtacatacggtttatgaagaagaagagatgttttcatatacatggtgttgggacaatatgttggggacaagtggatggacattttgaaaaataaattgaatccatactttgcaacatttgtactgcaaagtcaaaagccaaatgacaaaatgggaaaaatatttgtagcctttattattgataaatgacaaggctccctattatgtcaaacgaaagcatacaaatatacaataaagacaactgggaatatcaatataaacttgattttgtaaaaatatattttcaagttatgttcactgaaaggatctagaaggaatgattccccaatagcaatgagtgtacttagtcccagattttagtttctaaattgcattacctactaatagtatcagagttctttggagaaatgactgattccagctctggggtagggatagtaccagatgaacttaggacattataagcacagaagtgctcaaaggctaactggttcatatcaaaggacataagagcaggaatgaatgggctctcctttgccaaattggggacaatttgagccacactcaaaaaatgttagaaaagtagtacaacaaattgaatgaaaaaaacccatagtactcatatagaaagaaagacaggaatggggggcggggcggggcgcagtggtgggggcaaagaaaacactctactgaagaataaggtgataacagcactagaaaacaccattttgtatcctcagcccactacaataattatttcaggctaggatcatcaatggacactgaaatcactaagtagggttactaagcccactaagtaaggaacacacacaaagaacaaaggaaggttgggaacaagatattcacatggccttaaagtatcattccacagattattcaacaattacaaagaaaagaaaattaatttttacaatgaagagatctggtgttcaccaccttaattaaggactaaacttgacaacaccaaaagtgggacaagctgacatgatatgcacccgatatgatgcaaaccatttacatgtactttgtagattttttttatagtatttttgccaaaaaagtttagcctgaatataatcaggatgaaatacattcaaaatgttggacattttataagacagtgggtcgaaggccgggcgcagtggctcacgcctataatcccagcactttgggaggccaaggtgggcagatcacgaggtcaggagttcgagaccagcctgaccaacatggtgaaaccccatctctactaaaaatacaaaaattagctgggcttggtgacgcatgcctgtaatcccagctactcgggaggctgaggcaggagaatcacctgaacccgggaggcaaaggttgcagtgagctgagatcgcatcattgcaatccagcctcggtgacagagcgagactccatctcaaaaaaaaaaaaaaaaaaaaaaaaaaaaaaaaaaaaaaaagttggtccagtttgactcaaaagtcaatgtcataacaaccaaagaaagattctagattaactgatattaatgacacgacaagcaatttaagtatgaatctggactggatgctgaataaaataagcaagcaaacaaaaaactgcttgagacttatttgacacaattacggaaatctgaatacgaactgtttattagattagaatcttggttatttttcttaggtatgataatggtactgtggttagacagtaaaatatccttactttagcaaatgtatgatgaagttttgggaaggaagaagaaaatgcaaatttaggggttttattttacatttttccaattttttatggttaaaaaaaatttcaaaataaagttggggaataataggccctgaatagacatttaattatcttacagtaggcaaactgaatcttcaacagttttgcctgaatagacgattatcttacagtaggccaccgaatctttaacagttttgaacactgtaaaatattccacataagcagagtaatctggctttgagttatttatttatttatttatttatttatttatttatgatacagggtcttgcttggttgcccaggatggagtgcagcggcataatcatggctcactgcagccttgatctcctgggctcaagtgatgcttccacctcagccacccgagtagtgggactacaggcatgtaccaccacactcagctactttttaaatttttttgtagtaacggggtctcactatgttgcccaggcttgtcttgaattcctggcctcaagcaatcttcctgccccaacctcccaaagtaccaggcgcatgaaccactgagcccagcctgagttcttattttaaaaatgtctcagcattattaaaagcaattagaaaacaaatagagcactccttctcaactctggatttatcagatcaccttcctaaacataagagaaagctaaaaaattaatgcatgaatgaataaatattatatatttatattctacatgttgactgctctattcaataaatttactatgtttattgaaaaataatgttttctgggaaaattactgtcccaaccagagatatcagttatttataattctccatgattagtatttgttcctttacaattagaaaaaaacatacttcaagggataatttattagtataatatgccctgactctggggccattctgcatgtattagaagactggctctgacaattgttagatatgtgatcttggactagttatttgcaactcacatctctgggaagaccttcttgggctatgccagtctttaataatctgtattatttattcccaaatattagtcaaaaataaaattcactgataaaatgaatacataaagttagcagatttaatagacttctaaactaatgcccaaataatttaattgtgctaaccaataatcaaataccaactatactaatttctacctaaaaccataaagagttgcctacaatttttagtatttgataaatttcctcagtaaactctaatatggattgaagtctgttcaaatcgtatcgtttgtgacatgctctatatattctatctgaggctagcaggatgtgttcctaataaagcctgccacatatttattacactggcaaagccaacaaacttcaattctgtgtgttcaatccttaaaatataatttaatatctgtctttaacattattttaacaataatgttatagattgaaagtagattaacaatagattaacatagatttaacaatatattatggactgaaaatcaaaagtataaatataacaaggataagaaaggtaaatttataatttcagtatttcctttttactgatttgttattacaatgcagagttaaaaaaatacaacaacaaaagaagcttcttgtattttcttgtttcctcctttttttccttactgtctttctgggtaagaaacatccaagttatccacctcatagtcacccctaatagttcttagtttcttttcactaaatagcctcttccagcttatctcattaactcccatgggctcaaataccacacatataccaatgactccttcatctatacttacactctaagcctatattccaaaatacactgtatagttcctagcacagggcttgactcatagtaggatatttaataaatgaggttcaaatgattgagcaagctattagatatcgtgtttcagaaatgccataatatcttgtaggcatttcaaacttaatatatctaaaatacaattcattatcttcctctcaatattcctgtatctcctattttcatttatggattgctatccactcattcacctaaattagaagcctctggcaccctcaaattctacttctctatcttcactcacattctagacctccacgttaatgatttaacatctccactctcttacttcaacccccttctcctacctcaattattaaatcaccttttaactggccttcctagctgtaatgccctaacaccttttatgattcttctcatcttacaattagttcacatactgtcttctctatgaggccttattgtcttctttaacacagaatttgttactatatcatctgcattctctagtacactttgttcattccttttacagcaaatatcaaactatgcaatcccatctacctacctatttaaaaataggtttccagtgaatactagcagtgctagggatggggctgagttctgcacttcattcctacaaggttctgtacaatctgggcctgctgctacctctctgaacttactgttttctactctcctccttgttccctccaatctagctatactgacctctttgctgttcaaaatgcataccaagtacattcctgtttcaggatcttggatggggatgctattctcccaaacaacttacagcttcctagcttccttccttcctagcttccttttttccaagctcccttccctttccttccttccttcctccctccctcccccaactccctccctccttccccttctccctccctccctccccttcaccctctccctccctccccttcccctcttcctccctccttccttccttccttcctccctccctccctctctttcttcttctttgtcgtcatctgaattttgcttaattctcagctactttgtgaagctttccttgaccactccatttaaacagcaacccaaccctactcctcaggtgcaactcccttccctgctttgtcgttataatgtttttatttaacagccctctgcatccatgggttctgcatccacgcattcaaccaaccatggattgaaactattcagaaaagaaatgcatctgtaatgaacacatagacttttttcttgtcattattccctatacaatacgggacaactatttatacagcatttacattgtattaggtattataagtaatctagagattatttaaagtatataggaggatgtacacaggcaatatccaaatactgtccattttatattggggacttgagcatccaaggaccttgctatctacaaagggtcgtaaaaccaactacccagatactgagggataaccagactacatttgcttaatgtcattctccactagaaggtaagctacacaaagatgtggagttttaccagttttgttcactgatacgttcagagcatgtataaaagtgcctgggacactgtaagtatgcactgggtacttactgaatgtataaatgctcttgcattcccagtacctgcatgtgtacaaattaaacatctttttaagtaaaataacccccccccccccaaaaaaaaagtacaaagttaaaacaagaagggatttaatggtggaaaacattttttggtccattacattggtatggtattgagaatgtgagatggtgtgaacccattttttccaggtctttccataaaagagacattttaagttctagggaaaacttttaaatttaaactttgaacataagcatgatgatttagaaaaagattttcatatccaaagcaaagagaagttatttttaaaaatatgcttattatgttattttttccctgcagtagttcagtgaacattaagcacattaatttgcctgttatatgtgcatttatatctgccttttacattagcttttaaagtgttttactttcaactcttcattaaatcttcacttcaaaatcagactaaaaagactgagataacattatgcctcataatgtcactactgaagaagggaaaaaaaaaggaaaagtggactcccacaaaaaacaagcttcactgattctaagttggccaaaacaaaacacctgttcatgccctatatttctcagacaaatttaacagcaatgagatgtaaaagacttgattccttttaaaaaaagtggcaagtatacacaataacacatatacatacaaacacccatatagacattaatatgaaatacaaacacacccacatagacattaatatgaaataaactggagtcctactaagcataaactcacttattctcagaatgccgtaagatccttgggaggcagatttgaagaaagcatactaagatcattatatgacttgtgacacatgagccttacaaaaggccagcaacgaaatccagattctgagttctaagctatcatttagagaactccaaaatagatgatactgttgtatactgcatgggcaagataaatttctaaacaaggccataaaactaagtgcactttataaggatgatacatgtaatcggacttactctcccctctgtgctgccacagtgttttatacgcatgccctgttgaatttaccaccatcatattataactatttctttgcctgctggactccccagatagactggaaagcctctgagggctttcatcttccatttctcgcagtgcttggcagagtctctgttacatagtaggctctccataaacaatgcttgatgaaatgcttcaattaacttttgaaaatattaaaaatgtttttattttttaaactgaataacagttttcattagagtacttctattaaaatgtgttatttctggttcttctcaaaaaaaggatggaaaccagttagaaatcattcttaacttttattccttatgaattacagttgaatgttttcttagagaaagttgaggaaaaaagtaaattgtctgaaataagaacaatgttccactttttacttattaaccatttataacacaaaaatctcttacattgtttaaaaaaaaatgaccagtcacgcatatagtcatttgtcactttccgtatttctcagtaactttgctctcacactggtaggcaagttgctgactaagaacaacacagtgattctttacattttcattcacttttcattcaaggaaaaggcttcttaaaaatgtgcatttaaaattctagaaaatacaaatcaacattatctctaagtctctatcattaccagaaggtctggttcctaaacctaatttccattgttagttaacatcttcaataagtgatggatattcatttccagaaaacattaccagtaaattctattatatcacagactgttcactatccagaccaaactgactaaaccacaaaatgcaaaagtatgcacttcacttctctaagggaaaccttagggctattctgagtatagttttagcagattatgacctaagggtaaatgagagcttaattagatagcctccttctgaatttccagagctttcagtagacacaaactaaaatgtttaaaaactaaaaatttcttgtcacagatttaattttttaaaaagttactctgagacataaggatttacaaaggaaataaaaaaaactgttatttttgtgatacaagtgctatttcatttttcccccagaggaggaaacatgaagagctgcttgcttggttccaggcggtgcccatcctaagcaaaattagtaaaaaaaaaaaaaaaaaaaaaaaaaaaaaaaaatatatatatatatatatatatatatatacatataaaataataataattttttaaaaattggatcacttaccacagaatcacagaatataatggctgaaatgaacactgatgtgaaatatgcgaaaacaagtatatatgattaatttggagaaaaagaccttttattttgtgaattaaaatatttttcattatcagaaatgtgtccaacattttgtatatataaatatatacactgtaatagtgaagaactaaagatggcttaaaattatgattgattgattccttccttcccccctccctttttttttttttttttttttgagacagggtcttgctctgtcacccaggctggaatgtagtggtacaatcatggttcactgcagcctcaacctcctgggttcaatcgattcccctctgcctcagccttctgagtaggtgggaccacaggcatgtgccaccactcctggataattaaaaaaacattttttttaaagagacagggtcccactgtgtggcccaggttggtcatgaactcctaggctcaagtgaatcacctgacgggattacattggtatggtatagagaatatgagatggtgtgaacccatttttcatacccaaagcaaagtgttgggattacaggtatgagtcatcttgctcagccagaatggaatactcattttcttcaaaggcatgtattaagtgtattatcagaaaaaaaaagttatagaaaaacctattttaaaatctaagtatttggaaatatattttataacaacatcattttatatgcccaattatcttaaaaattgaactgtccatttcgatttgagattacaaaattataaaatgcattttatggttgatagtaaactatattaatgtagtcatatcgtcaaactataaaaaaataaagttatgcctggtcaaaataatttagctactttataaccaaccctctcatctcacctgttgcagccatatggcattgttgtaattcttccttcaattctcacttttgagtaaactgattactgagtttcctttaccctagaggcaaagcagtgagttgcaaaacatttactactttcaccacggtataaattatgttccgataaagtagctgaaacctttcaagtcttctactttatataataaaaaccacttattgaaatgttttcaacagtatgcctgaaagttatatttagaaataatacatatgtaccacagaaatatagattttaacataagacatttactaggtttagttctaagaacatagtgctttccctttctaaaatttagtgggaagttagataaatttaaaataaaaacattcaatgattaaagtagttctgaatatagttataaagatacaatctattattcctattgcactgtaagacaaacaaattttggtatttaaaacctttcacttgtagtaaacattttcctgtcctctattttcaaatgacaagtctctgaaatgaaataataacttgctcaagtcacagcattaagcaacagaatatggatctaaatacaaatgcctctgacctccggctaagtgctaccagaatctcatgtatttatttaaataggaaaaataagacacttctagagtccctattcaagctaatcaaaattgcttattaataacatcttcaaaatcatgatgatgaaatgccaccacaaaatcttcaacattaggcaagttttattattaaaagtgttatttgcattcagttttttaaatggtaatctattctttatattgtaacatctgatttgctgggagtcagataatgaagtggattttataaacttgcactggcccatatggtacctgctggctagatgtggtttttaaaatgtaaattggacaggcatggtagctcacacctataatcccagcactttgggaagctgaggtgggcggatcacctgaggtcaggagttcaacaccagcctgcccaccatggtgaaatcccgcctctactgaaaataagaaaattagctgggcatggtggcaggtacttgtagtaccagctacttgggaggctgaggcaggagaatcacttgaacctgggggacagaggttgcagtgatccgagatcgcgccactgcactcctgcctgggcgacagagcaagacaccatcccccccacctcccaaaaaagtaaattaattaaaatgaaataaaattaaaaatttagttcctatgttacaccagcctctagctaccatgatggattgtgtacatctagagttcagaaaagaggtatgggttgaagataaatatctgaaaatcactggcatatgagttaaagtcatgggatcactaagggagtgggcatatatagggaataaaacagggtcaaattgcagtgaaaccatcttataagacatggaagaaaagaggaaaaattagcaaaggagaatgaagagtgcctaatgagataagaggcaaaacaagagaatgtggtatcccagaaaccatgtatttagaagtgatccaatgtgtcaaatgctgctgataggttaagcaagataagaacaaagaattgaccactggaattagcaatgaaaaggtcacttttgagcttgaaaagaagagattagagatttcaacaaattcatagaagacggaaaacgattagaaacatctgtctgaaaacattattggagggctgtagtagatatagaagctatctgactatgaaacctgtgaatttggaatcagcatatttgtatgggggaaaacctgactgaaaaccaggagaagtaacagaagattcatttgtacaatacgtaagctaaacaggctgtgaaatccctggaaagtgaaggatgcccagcattaacagcctgccacaaaacaaaaacaaaaacaaaacaaaacaaggaaacattgattgatttaggaaggtgtaatggcagaaatcagtgtctttaaattctttcttaacttaccccagacacataagtctgaggctttaatatattcacaacatttttaccatttttatgatgttatagcatttaccaatgggagaacactgatcacactgtagtgagtaactgtctacttctaacaaaaaactgttgactcttgaaggcagggtgtataatttttaatctgaacaactagcacaaaacatatcgtctggcctactataagcagttcagaagctgaatacaacaagtggtttctgaaggataaaggctgaattagaaatttggtgttaattcctaatctgaagttcattcctccacgtatcagtgcttctgtcaataaacaattgtaacaaaacatttttggtaaaaaaaaaaaaagcaccttttcttccattttgatgttatctactatagaaaagtgttttgtttttttttttcttttttgagacggagtctcgctcttccgcccaggctggagtgcagtggcatgatctcggctcactgcaagctccgcctcccgggttcacaccattctcctgcctcagcctcccaagtagctgggactacaggcacctgccaccgtgcccagctaattttttatatttttagtagagacggggtttcaccgtgttagccaggatggtctcgatctcctgaccttgtgatccgcctgcctcggcctcccaaagtgctgggattacaggtgtgagccaccgtgcctggcctagaaaagtgttttttcttttctttttttgttttttttgagacggagttttgctcttgtcatccaggctggagtgcaatggcgtggtctcagctcactgcaacttccgcctcccaggttcaagtgattcacctgtctaagcctcccgagtagctgggattacaggcgcccaccaccatgcctggctaatttttgtaattttagtagagacagggtttcatcatgttggccaggctggtcttgaactcctgacctcagctgattggcccacctcggcctcccaaggggatcataaggcatgagccaccccacctggccttttttcttttttctttttgagacagggtcttgctctgtctcgacctccaggctcaagtgatcctgccatttcagcctcttgagcagctgggactataggcacatgccactacacctggctaactattttgtattttctgtagacagagcttcgtcatgttgcccaagctggtctcaaactcctgagctcaagtgatcttacacctcagcctcccaaaagtgctgggattacaggcatgagacacagcaccttgttgaaaagcattttcttaagagaggaaaaactacaggttgcaaaatggaattatatgaagtatctcaagattttttgatacctctggggattatgttcttagagatggtcaaattctaagagaaacagaggctagcaaatggagttctgttgttgcttttgttctattttaatgtctgtggaataaaggattgtcccccaaccgaacccatgccctgtagattttggccagattacacagatgagagaatactttgattttaatcatcttaaaatctcaatgttatctcattacatgccaaagacggcttaagggtggtactcgtgtagaaagctaaagtttggaaagttaagtgttctagtggattactcaagtttaagatgcttgacaactttcttcttgaaattacttcatcttaatgccttttttggcatgcttctaaaaatactatatccattatttgtctctttgacatgttccttttcctataatcatcacttaacaaattttattaagttgtatcttaaaatatcttccactcttttggcaataaaacaaactgtataatttcaaactaaaaaaaaaaatcaaaaaagcctcccataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcctgctgacgtcagcgcctgcctacgccgccgttcccatggcgaccgatgcgtcccgcgctctaggcgaagaccgcggccccgtccccgcgcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggtaagggacccggaaatgcgcgggtgcccctacagagtcttgagttttccccgccctcacctccgaaaatgctcttttcgccttagaattgtagctagcgcagggaaaaactgactgggcaaaggaaaactggggaggctgtcatggaagccgcccagaataagaaaatgaatgaatgaggcaaagaaacagatttgtcactccccacgcgatcgcgcccacaaaagaaaacatggttttaaggcgtggaaaatgaagttgtactacagacaaaattttaagaaaaaattatccactgttcctttagagctatctccctgtgtgtgaaaaacaaaacaaaagttaaaacgccatccttttctacacctaatgctccctcccacttttctgatttctgccacaggcgccatcttcagctctgagtcaccagggctggaaaaatactagatgcgctactcgtggactcgtgaatacactcgtgaatacaggccatttcctgtacctacagccacccgctgtaagctgttgcttcatttgtacagtaagagtttatggaggccagcttttccattcttactgacattgccacaccttacaaactatatgtcttgtgcttccctaaatcctgtgaggaagcaacgagaaagattactaatccaatgcgtaccgaactgagctgttcaactttccgttctaaacatactctcctagatttctatcttgctgtaagccaccacaatcctcccagtgttttagtaagaacagtagagtatcctaaatgcatcttatgccaaagcatatccattctctctttttaacttcctcagatgggccctttaccagttctctgactccagtttgactcttaaattctccacactgctatcagaatgacctgactaaaaatgtaaatcggataatggcactctcctgctgaaaatttttgaaaggcaatctgtaagagaaaatgattactttgcctaggatacaagattctccatctccctgactagtttcatctctcgttagcttcttgttccaattttatgcaatattgaatcatgtgtaccatgcagttttatgcaacattgaattatgtgtaccatgaaaaacaatccatagcctttcacgccccgtccttactcatattgtcctctcttcctgaaaattcctccttttacactcctgcatcacagccaaatgttgtccatcctttgaatcttaagcaggttgactgactccttcaaacactcctactccctattagacttcggatactcattctatatattagactttggatgctcattctatagtttcatagtttactttgtattttctctatccccagcatctaccacagtgtctatgaaatagttggcatttcatgaacatttgttgaatgaataatggataacatatattgagctccttctaggaggtatgcattgtaggtgttttatgtacttttcatctgtcctcacaactgcatttaagtacctgcttttccaaagggaagttataactctgactgctcattcttagtagggtgttagtttcagaatacaatccccagactagcggatgtgtaaccctgttatcatctcttgcttctccatttacagtagcatgcagaggtgcagtggggtgggggaggtcagggaatatttcatagcagaagtgacatttaagtaaagaccaaaataatgtgtagagttgtccaggttaggaagggtttccaggtagaagaaggtggcgtatagtgttcactacaagaaagtttggtataatacaagaactggaagaaaaaaaaaaaaagttcaagttggctaactaaaaggtagagaatgagactaggggcttttggaggagacaaaacaagagagttaaacaagctatgaagagacccagacagtattggtcagtggaataccactatagaattttatggagtgaaattttcaaattttaatatcataaagataactctggctgcagggtggagaacagacaggaaggaagcaaatctagatctgggaataccatttaagatgccgttgctgtaagccatgtaagagacaaaggtggcatggtcaaggctaagaaaaatcagaatggagagaaatggaccaatttgagaaatttttaggaggtaaaaatgtcaggacttagtgattgattggatggaagagtgaatgataagaaataataaaaaacgatgaccagctgttttgccttccccttggcaagtaaagaggtggcaagcatgaaaggggagtgaggaaataaatatgttgggtctaatgggagccaggtttctcactgacagagaaggacgttacaaattgagagaggaagaattccacagtgacctttgtggtgatgttgaattggaattgaatatgtcagtgtcaactcatagttttcaatatatacataaacatatgtaaaaataaatatagaggaaagtatgtctgtatgtgtgtgcgtatctatctattatgctcttcctagctctatctgctgaaagggtttcagagtaatggtatactagaagcaatgagcacatgtgcctagatcttggtttctgaacagtattattcactaaaagtaactgggtcccttggagaaatggttgattttagaacaggagcctggaaaattcttgttgcaccagaagttaaggaagttaatacagaatgaagaaacatatcaaaaggtcacagaagccagcttgaaggagccaccactggccacatctgggtcaatctgagcaccaatataatgttaatggattatagtccgctaaataaaataggaatatttgagcccatactaaaatgaataaatgatttttttgaaaaatcaggataaagaaaagctctgccttacataaaaatgccaactaaatgtaatgaatgtagacagtgttatatgtagaaacatcattatttggcagtcatgatagtaacagttgattcagactagaatcatcagtgtatgctaaaactagagggtgagagtattaagagacatataatatttatatagtctcaaagtatctctccagcaaatacttattaattacacagagaaaaattagaaaacttgacagtgtagaaatctggcactggtgagcgaagttaccatcagcagtcatgagacaaatcagcatcgtgtatgtcctggttagaggcacttagaatacacttctgtgacattcctgccaaaaatgtgtaatccgaatcaatcgtgaggaaaaaatcagacaacccaaatgtcccaaattgagggacattctacaaaataatagacctgtactcttcaaagatcaaggtcatgaaagacaaaggaacaactaaagaacgtttttagattgaaggagaattaagatacatgacaattaagtggaatacatgattctgaattgaatccttttgctataaggatattattgggacaactaacaatttgaatggggtctctggattagatggtagtattttaacaatattaatttcctgattttgatgactatagtgacatagatatttttggttttagaaaatacatattgaagtattaaaggtgatgaggcttcatatctgcaacctattcaaatggttcaggaaaaaagtatacataaatactgtaaataaatataaacataaataatatacataaagaaaatgataaagcaaatgttaacagggaatttgggcgaaagcagaagttctttatactattcttgcaatttttctgtaagtttataattattttaaaactataaaagaagtttgaaaggtgccgaggtttctggctcaggtaactgggtggagaatggctaatcagttaacgacaaaaaatcaggaagagcaagcatggaggaaaagatgtttagttgcaatgggatgtatggagtgggatgttcagcaggcagttgagtatatactaaacatattaatgagccccattcaaactgaataaagcagatatgttgctttagctctcattagtcgagagtgcaagaccaagggcactccgctatcctaggagaggcaaacaattaagagtggtagtatggtaataattctaaaaattggctgagtatccatgaaaaaaattgtgtgtatatatatatatatacacacacatatatgtataaacatatatacacacatatatgtataaatatatatccacatatatgtatatatatacacacatatatgtatatatacacacatatatgtataaatatatatacacatatatgtgtatgtgtgtgtgtgtgtgtatatatatatgtatgtatataaattgaaccgtttaggaataaaatagatttagggtattcgacacatttaatacataatgaatagtgaatttcttgaataatataatgcctaaatgtgactgatatgcaaaatatttaaatcccttacaggatgtgcatttaccaatcagaacagatgttggctttactgcttgtattagttttctgtattagtttgcttgtattagtttgctggggcagccataacaaagtaccacagaaatttatattctcacaattctgggggctagaagactgagataaagatgtctgcagggttggtttcttctaaggactctcttgttggcttgtagatggttgttgtctccctgtgtcttcacctgcacttccctctgtacctgcccgtatcttaatctcttcttataaggacagagtcatattggattagggctcaccctaatgacctccttttaacttaattacctctttagagactctgtcttcaaatacaggcacattctgaggtactttaaggttagaacttcaacatatgcatttggaactggggcataactgagtccatgacactattggagagggttctggagccataacagatggaatgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaaaaaaggaaaaaatactcaataccactacccaagagaatctaaattaacttttttgacaaatttcgtttcagtctgttttccatgcgtattttaattttggtcatgttgtgtgtaaaatgtttatttctgcttacttgaatgaacattatgttgcaatttcatttccatgctattacaatagtgcccccttaaccatggttttgctttctgaggtttcactcaacaagcttggtttgaaaatttttagagagaaaataagagattacatttacataataactattaatacagtatattgttataaaaactttatattgttattagttattgctgttaatctcttactgggcctaatttataaattaaactttatgagaggtgtgaaagttgattatagaaattgggtcattcttgttgtacccaactaaatcagagtgaagggcccaggggaaaaagcatttggggcatatagcatctgctccaagaattaaattttccacaagcccagctactgaaactgcctgttgtaatctgaaatcagttttatctgatagctaatgaaataacctgctgtgacactaagattagttttacccactgccatcactcgccaatcagagctcgccagctccccaaatgttacccattgtttctttgcaaaacaatgggtaacatttttcctttttataaaacctccaacctgatctttgtttttcagacatactgaagaccacccattctgtgtgtttgcctggaaatgcaattctcatttcccaaataaaatgtttgaaatgtggaaatttgactctatgttttatttgactttgagaaaggcatgcaagtatagtaaatacaggctttgctactacctgtagtttcagacatccactggggatcttggaacatatcccatgcagataagaaggagatgctgtatatatcaccacttaatcatcactggaaattctaactttgttagtaatgttcttatgtgcacgtggaaaaatttcaaacaatcgttcagatatttataatgtggtaaccgaaagtcagccgtgtttttaatcactgatcagtcttctatacattctttcatacttccattcatacatatactaaatatactaaattataaagataacttcttaccatagattttgtcctgtcatcttgtttttgtcctttatcaagtattattatttctaaaaggctttttatgtcagtaacatatatctaccccattcattttaatggctttatgctatatcacttctaatccaaagtgtttttaagcaattatagtgaaagtgtcaaaaggtgatatggtggcttttaaaaaataagatacttttcttataagtctctcatattattatttattcctcagcattttatagatttttggtgctattttgaatgcatccaattcttattacattttctaaccggtgattgcacattttcctgcttttcctctttctagggctcctttactagttcatgcctatcaccttgacctcttgatattggaatgtcccagaggtatgttcctggacttctctatctacacgtactcactcagtgatttcttacagttctatagtcccactgtcatgtagactactcccaaatatatcccttctgcccattattcttccttgaacttcagactcataaatctaactgtatattacatgtctccacttagatgtccgacatattctcaaacttaacttttctaacactgaattcctcatctgcctcctcaaatccccactttctccatctcaagcaatgacaactccattcttccagttactcaagccaaacaccaaatacattggagtaactgttaaatcaagcttagcctaaaactacctccttacatattttaaattcagcctaaatgtttctttgtacatcttaaactataacaagtagaagtgtaaccagatgtagcctacacttgggccaatcaccaagttttggccaatcaaatgtcgtcaactattcaaaccatgtttaaataaggcaaacacaaagctgtaaccaatccagctggttctgtacctcacttccattttctgtgcctcactcctttttctgtccataaatcttccagcacatggctgcgctggagtctccgagcctactctgtctgggaaggctgtctgatttgcaaatcattcactgctcaattaaattcctttaaatttaattcagttaaagtttttcttttatcataacctttgacctttctccttttcttataccccatatccaacctatcagattactataggttcgaacccaaatcctatgaaacagaggatatggttataattttgagggaagattttttttttctctacctgaactttagcccctacaaacaaacttccttgtttatctttgctgctgtaatcttttaagggttccacttttatgcaaacatcttagttctcacactgagcaaggccttgaatcctatgctttgggaggccattgcattctaagactacattcctggcatcagcaagtgcccctctagtaaaaatgccctcagcccctactttccactcttgttttagttctttcttctctttggcccccgaggaattcaatgatgcaatttagtcagcatttctagctggttttcaggttttttttttttttttcagagtatctttgtgacatattgggaaaagaggaattccttctctctcaactgttaatacatgttgaaaggaattttatgagtaatagtaatggctttgtaatagtgattgttactcaaatttagcagatgacttactgaagtaattaaaccttccttataccctttctgtgggtggcatgccacgaaaactcgatcaacctgtatacatgggttaggtagaacccactgagctttccattatgtataaagctgtctgtagatttactggctgtgtataaataccattttattaggaaaatgttttggtttaggtctcagaaggtcccatgaaaaacagtaacttctgcagagactaaggggaagagttaaaaaatagtaataatttaaaaatccatttcagcatatgattaattcagttgtctaaagcaatgagcactagatggcagcatatcaatgtgtatcgttacctgtgcctgaaagacctcattttaagggtgtgtaaggtcttattgctgttttaccatgcaccagtttgctatcctgaactatttactttactgtttaatctgttggtttgaacttataatagttgatgagatgtatttgacaccaggtttgaaaatagagtttctagattaataaatatacaggatggtgccggtaccaccagtctgtctagcaaaatatgcaagaattcagagccctttcctgtcattaaaggccaccctccagagagcttatctttcatctatgataagaggtcttctggttggacaaaaagcacattttggacactcattcctgtcttgagtttcaaaccttttgtggccgctaatgtttaacttttcatcttactattcaaatggcatctctttactagattggaaaccactttcgtatctcttaccaagtgtgaaaataggggcctcccaaactctgttgtgggtagttaccaggtcttcttctctaaaggactcaggtcagatatctctgtcacagatgagaaaggaatttccttcttatcacatttgattgtataattagtatttaaaatgtaaaaaagaaaaaatgacataactttaatgtataatttaactggatggctccatttttctcttgttaactcagatcatttataattttttttcttttaaaatgtttagaataaattattaaagtacatgttaataatacaggagggggctgggcacagtggctcatgcctgtaatcccagcactttgggaggctaaagcgggcggatcacttgaggccaggagttcgagaccagcctggccaacatggtgaaaccccgtctctacaaaagtacaaaaagttagctgggcgtggtggtgtgcgtctgtaatcccagctactcgggaggctgaggtgggaggatcgcttgaacccaggaggcagaggttgcagtgagccaagattgtgccactgtactctagcctgggtgacggagcaagaccctgtctcaaaataataataataataataataataataaaaaaaaatagataaataaagggcttacaaggaaaaattccaaatccctgcttcacctattccttgccacagtactgttcctgagaccaaattggcttaaatagcttctgtttttgtttcttctgatgattacccatctcttactactatttcttgattcatcagttttaaatattgtcttaatctattgtggagagagatgggcagtgatttaactcattagcattgccttctactgtccctatccatctcttcccaataaagtcatagaaagaggcacagcagtataatagataagagcacagactcaagtcctacttgcaccacttgctggctgtataatcttaggcaagttactcaagctctctgagcctcttttttttctcatgtgtaatatggggataataatagtcaattccttggaggattattgtgaggataaatgtgtcaataaatttaaagcactaaacaagtgttactattactattactacatttaatttctctttgcatgtttaaataacatacttgcccctttgtttttgagccctgtatgtattatctcttgatacctcccatcgtaagaagatattgacaactttattcttcccttcactcccgccctcttctgcatcttaatctcaccttttattccatctctaactgcttttctattctctgggagatttttttaaacttaatcttctaaccatatattgaaaaatttactttagcaataacatttataatttctgagagttttatttctaatgtttaattttatagaatttaaagattcagtattttcttgactattgtgttagagttcagtcaaagagcaaaaatgaccacacccataatttggatagggaagataactgtgaactaagtaaaggatgtattaactactaagagagaactgtaaaatataccgaggtagtagctgcaaaaagtacctgctactcctaggattgaggaaaaattgaataaggaaggaaactggaatctccagaggcagagattcaggcctgagtgggcatggttgccgcaggaatgcccctctgctgctgtgagaaacaccggagggacccttgcatgcctgacaagaggaaaagaacaccagaacaaaaattgcctcttgatcatggcttatgatcctttggatgtgctgtggaatttggtttgcttgtccttggttgaggatttttgcatctatgttcaacagggatttgggccttgtcatttcttttcttgtaatgtccttgtttggctttgatatcatgctaatgctagccttgtgaatgagtttgcaagtgttccctcagcttcaattttttggaagagtttgacaagagttgctgttacagtaattaccagtgaagtgaaagagctttgcgctttttgttgttgttgttaggaggctcttgattaccgattcaattcccatactcattattggtctgtcagattttctgtttcttcataattcagtctaggtaggttgtatgtttctaggaatttatctctgtcttccagtttatccaatttgttggcatttaattgttcatagtagtctcttagaatcctttgtatttctgtggtgttaagttttaatatctcttctttcatttacaattttatgtatctgagtcttctcactttttccctcagtttaagtcttgtcaattttgtttatcttttcaaaagataagcaactctgagttttgttaataatttctatttcttttctagtgtctattttacttgtttctgctctaatctttattgtttcctaatttctagtaattttgggcttagtttgttctttttctagtttcttgaggtgtaaagtcagattgcttatttgagatctttcttttttctaaattattatttattattattattattattattattattatactttaagttttagggtacatgtgcacaatgtgcaggttagttacatacgtatacatgtgccatgttggtgtgctgcacccattaactcgtcatttagcattaggtgtatctcctaatgctgtccctcccccctccccccagcccacaacagtccccagagtgtgatgttccccttcctgtgtccatgtgttctcattgttcaattcccatctatgagtgagaacatgcagtgtttggttttttgtccttgagatagtttactgagaatgatgatttccaatttcatccatgatgtccctacaaaggacatgaactcatcattttttatggctgcatagtattccatggtgtatatgtgccacattttcttaatccagtctatcattgttggacatttgggttggttccaagtctttgctattgtgaatagtgccgcaataagcatacatgtgaatgtatctttatagcagcatgatttatagtcctttgggtatatacccagtaatgggatggctgggtcaaatggtatttctagttctagatccctgaggaatcgccacactgacttccacaatgattgaactagtgtacagtcccaccaacagtgtaaaagtgttcctatttctccacatcctctccagcacctgttgtttcctgactttttaatgattgccattctaagtggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatttcgtaggttgcctgttcactctgatggtagtttcttttgctgtgcagaagctctttagtttaattagatcccatttgtcaattttggcttttgtcgccattgcttttggtgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccattgattatatagggaatcctttcctcattgtttgtttttctcaggtttgtcaaagatcagatagttgtaaatatgcggcattatttcagaggactctgttctgttccattgatctatatctctgttttggtaccagtaccatgctgtttggttactgtagccttgtagtatagtttgaagtcaggtagcgtgatgcctccagctttgttcttttggcttaggattgacttggtgatgcaggctcttttttggttccatatgtactttaaagtagtttttttccaattctgtgaagaaagtcattggtagcttgatggggatggcattgaatctataaattacgttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtctgtcatagatagctcttattattttgagatacgtcccatcaatacctaatttattgagagtttttaacaatccgagtctctgataaaacagactttaaaccaacaaagatcaaaagagacaaagaaggccattacataatggtaaagggatcaattcaacaagaagagctaactctcctaaatatatatgcacccaatacagaagcacccagattcataaagcaagtcctgagtgacctgcaaagagacttagactcccacacaataatagtgggagactttaacaccccactgtcaacattagacagatcaacgagacagaaagttaacaaggattcccaggaattgaactcagctctgcaccaagcggacctaatagacatctacagaactctccaccccgaatcaacagaatatgcatttttttcagcaccacaccacacctattccaaacttgaccacatagttggaagtaaagctctcctcagcaaatgtaaaagaacagaaattataacaaactgtctctcagaccacagtgcaatcaaactagaactcaggattaagaaactcactccaaactgctcaactacatgtaaactgaacaacctgctcctgaatgactactgggtacataacgaaatgaaggcggaaataaagatgccttttgaaaccaacgagaacaaaaacacaacataccagaatctttgggacacattcaaagcagtgtgtagagggaaatttacagcacttaatgcccacaagagaaagcaggaaagatccaaaattgacaccctaacatcacaattaaaagaactagaaagcaagagcaaacacattcaaaagctagcagaaggcaagaaataactaaaatcagagcagaactgaaggaaatagcagcaaaaaaaaaaacccttcaaaaaattaatgaattcaggagctggtttttcgaaaggatcaacaaaattgatagaccgctagcaagactaataaagaaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaagtcctccacacatacactctcccaagactaaaccaggaagaagttgaatctctgaatagaccaataacaggctctgaaattgtggcaataatcaatagcttaccaaccaaaaggagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacgaccaaaaaagagaattttagaccaatatccttgaaggacattgatgcaaaaatcctcaataaaatactggcaaacgcaatccagcagcacatcgaaaagcttatccaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattctaaattattattaaagcaggctttatctctataaacttctctcctaaaactaattttgcagcatctcataagttttggtatgctgtgttttcattttcatttgtctcaagtttttaaaatttcttttttgatgtcttctttgacctattggttgttcaagggtttgttgttaacctaaatgtctactgacagatgaatggataaagaaaatgtggtctatacatacgatggaatattactcagccttaaaaaagaaggaaatcctgccatttgtgacaacatggatagacctagagggcattatgctgtgaaataagccagacacagaaagacaaatatgatctcatttatgtatggaatttaaaatagtcaaactcataaaagcaaagattagaacagtggtttccagggactaggggaagggggaagtggggaggtgatgattaaagaacataaagtttcagttatgcaaaataaataagttctgaagatctactgtgcagcgtagtgcctatagctaaaaacactgtattatatactacaaatttgctaagggggtagatcttatgttaagtgtccttagaacaaaaaaaaaaggagtggagggcagaagaaattttccaaggtgatgaatatatttatggctttgatggtggtgatggtttcacaagtatatatttattctcagactcactgagttttatacattatatatgtatagctttttatatatcaatcatacctcaataaagtagtttgaaataaaattaaaaacaccccctccaattctgacctcagtgtccaaccttgcagtttcttctcccagtgacctctattaacagagcctacatggaaccagccggcaaagacaagttccactgtcacaactagagaaaagaggatgggtttggaattgaaaggtaatagattattaactggcataactatctgtgaaaatattcaataaatagactgtttccttcaaatccttgaatcatttcaactttctcagtggactttttaatcttggtttatctttactggcctccctttaattctggagcctttaaaaagtgtccagggttccttagttacttgttaaaaataagggaatgaaaagttgattggttgtgggctgggcttgtccattgatcaactttcctttagggtgtttggatgggaaacaaacatactgactgcccggcttttgtccataacatgcagtttgtatagagaagaatcttctgcctttttgctagagtggtaaatccctgggttcccacttcttggggtaagggagttggggggcaattttaaccaacactaattttcaattaataccttcattttctactatatgcttccaattggtgttttctgagcttctctgtatttctgcaaggccaatttactcagcttccatagaaaccatttgcattaatttcttgtggctacctgtaacacattgccacaaacttagcagcctttggaacaatagaaatgtattctttcacagatctggaggccagaagtcaaaaaaatcaaggtgtcagcagcctagagtttttgacttctggcctccacacctgtgcagccctcccttcagaggctcggcagggaatatgttccttgccttgaccagcttttggcagccgttgacattcctcagctggcagctgtgtcactccaaatctccgcctttgtcttcacaggcccttctccttgtctatgtaatctgctccctgcctcactgttaataaggacagttattgttgaatttagggctgcccagaaaatccagagtgatcttctcacctcaagacccttgacttaatgatatctgcaagactctttccaagtaaggtaacattcacaggctgaggaatgaagacatggacatatctctttgattaccaccattcaactcactacaccactcttctaactgcttaatctctttaggaaatttgatgacctttcttgtttgctaatggcctgctttctgtcctttttattctttattgattttgtgtatttctctctcttgctctttctctctctctttctccatatatatggagaaacacacacacacatacacatataaagtatatataacaacaaatatatatacatacacacatatatataaaatatacataacaacaaatataaaatatgtgtgtatatatgtaaatatatataataattgtgtatgtgaatgtgtgtgtgtgtgtgtatgtatcctttataaccacttactgggttattaggaataaaataatataaatgtgtgtggttagtccacaatcttgactttcacatatatagtttatttcaaaagaatttttactaggtaatctctgaataaaatcaaattaagctaaagtctgggaaagtacagaacaaataagttaggttatgtaaaagagcttaatttaattagcagtttatgtatctctcctctctcttgctctctctctctctctctagctctcgcctcttaatatttttcaacctgttctgtcatgattccacaaatattcaagtccttcatgtttccagggtaacagtaagtattcggcagtttatctgacaccttccatttaagataggaaaaaaataatagaaagaaaatgtcattaatgtatgcaaggctgaccattatgacatttggctgtctgttatctttacaaatacgttctcttctttcccatgtttctggttgcaactttctgaccagtgataggaataggtggcatatatgctacccacttctccaacttgctcttgtccgtgattactaattggttatataattcattttcggtaagcctggatataggttcaaaattattttctatacaatattaaggaggcataacaatttattggagctggcatgtaaattgaaaattgcttgctgtttatgctccaaactttctacctcacagatctcatgactcgaatatattttaccactacagttttctcccatagttataattttgtcattgcttctgctctaaccaagcagttagagaaggcagtacaatatagtcaaaagagcactagattgggtgcaaaaaagcttgagtttttgttctatattaattacttgtgttatagtggataaattatttatccttctagatctcagttttcttgctaaggcaataaggcaattggactatggtaattcctaagatacttaacaactctaaaaacttttaatatccagcagccaactagatatttccacttaaacgttacatcattacccaaaattcaacccatcaaaaaatcttaattcaatgccctaaaaacatctttgccccttaggtttggtatttctcgtactttgcactctaaattcaaaatcttttagtcatgtttacttctcatcttttatttaccttctatagtttatctattaccaagtactataaattcttccttaaaaaggcctttggctctatccattactttatatatcagctctcactactctgactcaagaatttatgttcccaataaacttgacctttcacttcccttgttagccttatttctagatattttatctgtttttgtggcaattgtgaatgggattgcctctctgatttgtctctaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaagcaatttacagattgaatgttatttctatcaaactaccaatgacatttttcacagaactagaaagaactattttaaaattcatatggaaccaaaaaagagtctgaatagccaaggtaaccctaagcaaaaagaacaaagctggagacatcccagtatttgacttcaaactatactacaggactacggtaaccaaaacagcatggtacttttttacaaaaggagacacatagaccaatggaacagaatagagagcccagaaataatgccagacacctacaaccacatgatctttgacaaagctgacaaaaactagcaatggggaaaaagctccctcttcagtaaatggtgctgtgataactggctagccatatacagaagattgaaactggacccctgctttacaccatgtaaaaaactcagcccatgatgaatcaaatacttaaatgtaaaactcaaaactataaaaaccctggaagatatcctaagcaataccactctggtcagagcaacaagcaaaaatttcatgaagacaccaaaagcaattgcaacacaagcaaaaattgacaaataggatctagttaagcttaagagattctgcacagccaaaaaaaaaaaaaaaaaaaactatcagcagagtgaacagacaacctacagaatgggagaaaatatttgcaaactatgcatattacaaaggtctaatatccagcatctataaggaacttaaacaaaattacaagagaaaaacaaccctattaaaaagtgagcaaaggacatgaccagatactttgaaaaagaagacatacttgcggccaacaagcatatgaaaaaagcttgatatcaccgatcattagagaagtgcaaatgaaaaccacaatatcatctcataccagtcagaatggctattactaaaaaataaaaataaaaagatgctggcaaggttgtggaggaaagggaacacttatacacttggtgagcgtgtaaattagttcaatgattgtggaaaccagtatggcgattcctcaaaatcctaaaagcagaactaccattgtgcccagggatcccattattgaatatctacccagaggaatataaattattctgccataaagacacatgcatgcaaatgtttattgcagcactattcacaatagcaaagacatggaatcaacctaaatgcccatcagtggtagactggataaagaaaatatggtgcatacatataaacaaatattatgcagtcataaaaaagaacaagatcatgtattttgtgggaatactgaataatccttactgtcccatgaagtaggttctaattatagataagaaaactgagatacagggaaactgagcaagttgcccatgatagctagtaatggatggagacataatgtttgaactcaggcagttggattcagagcctggattcctagtcactgcacagtgtcaatgcctgacagatagatgttacgaacgttaactgttatattaattgctgtacattttatcaactagatatccattccattctctccacagccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagacgtaagtttctctcatatttaaaggagagttatgccatatgctctcataatcatgcatatttccttgtccacttgccaaaatcctatttctccttcaagtctccttgtaaataccatttctcctttgaaggagattcaattctcgattccccagggtagactaggtattaatacttatgctatgctctaatggcctttgaacacacatgccacaatacatttatatatacaatgaatgctggtattttatatcccttttttatgataagcaccttaaggacactgctgatgggtatctgtcttagttgttttgtgctgttgtaacagaatatctgagactggataatttataacaaacagaaatttatttctcatggttctggaggctggaaagtccaaggtcaaggtgacagcaggtttggtgtctggtaaggacctggtcttcatttccaagatggcaccttaaactctgtatccatgccagaagagcagaagagagtgaacccattctccaaagtcttttttatagtggcattaattcattcatgaaggcagagtccccatgacccaaacaccttccattaggctccacctcccaacactgttgcattagggattaggttttaatgtgagttttggagggaacaaaaacattcaaagcatagcactgtccatctttgtattttcagtatttgtcacagcactctgcacagagtaggcactaactaattactgtataccttaactgactttcattctttctataccactcagaaaacatcaaagccatagaaacacaaagcctccctcccactaggtttttattttaatcagcagttctcaaaattttaagaaatgggatttcttggaaaaattcaaaatattttggggagaaaccacaactgggtttgctaataaatgctgatatctaagtactgagctaattctaacaaaattaagatttgattaaactgacctagaccaactgtgagacttgggtgggatggcagagaataacaagagagaacagaagaaggtactcttgggctgaccactggttcaatattcctagggtgcccttgctgtcccagaataattatcatgttctgggctttgttctatgagttatagctactccttttttcccacttgtgtttctcgcatctgaatctccctcctttaagccttatttaccctgttgataaagctaaacttctgttttatctccaatctcttgtaatttatttatttatttattttagtaatctcagacctcttatagaattgagcccctgttgtgttctttctagcctcttttctgtaaaactacagaaattctcccaatcttagcttagttgccaagttcctgcctttaatggacacactaactagaaaaagaacttcaaattgcctgcattgataatagcatagtggacgtgtgtgtgtgtgtgtgtgtgtgtgtgtgtgtgtgtgtgttttctgcccagcatccctttcctctagtttggtaaaaatacgttcattttaatatgaaaaataatcccctcaccctcttccattgcatgtggtcttacaggggatgtcagtgaaagagccctacccaaggcattgacacttggcctaagcaagaacaatccattatttctctgcaaactaaatctgaaatggtcttcaacagttaagatgttagtgatggttaaccatctttagggagctgccatcacagtaaccatcactaaccatcttaactgtttaagaaatgggatttcttaaatatagaacctagcccagaacatggtaattaactgtttaagatggttagtgatggttagcgtgtgctggcagctctttaaagagactattcattagtcctgaataccagattattggggtcgtcctgtttcctgtagtattctacttaatgcttgattgtttagctttttatttagttctgtgaaagactccatacctttccaataaattattttttgtgcccttaaattagatagggttggtttacattttaaaacccaaattgacaaatgtaaattccttgttgcagtgctctctcagcagctgggacccggtcttggaatcttagtgtcaactatgatgaatcaccaacactaacaaaaacattatcttttattgggttaaatagtttctactcttcccaagactgggaactgatgtaacaggcttcgtgctttcttcccaacaaattgattctgtgtggtcagctcctgtcatgatgatagaaccccctgtattgatttatacttaggggtatatcaatgtcagtctaaacttgtcctacctacttctactgcctgatgaatctttttattttaatctttactaaggtaaaacttacatattacaagagtcaccaattctaagtgtatagttcaatgatttttagtacgtttatacattacataaccatcaccccaatccagtcttagattgcatgcccaatcttgttgtgtgtattttccatggccattgatggatcctagtatcatgtactgcacgggctataccaatatcaggcccaagatgtgtagcagtcaatcctggaggtcttgtggtgcccttaaatataatgtaaggggagagtgtcagtgtggtggattcaggggcaattactatgctattgaagaagcactgccaagggccaaatagaaaagacactgggctcaaataataaaaatcagcaaggcagacaagaccacaggaaacagggcacttggaagaaatgccatagagtccagtcagctgctgctggatagatctgactgcttttcatagatgtagcacacatctgcttgatgacgtcacctgatgccttctatgccacatgtttcaacttcatttaatacaaattttttcacaaattagaattaacattttaaataaaaggggttgaaaatattaacagataaaagatttgccttggattgaatttttttattcctcctattaccattcattttaatgtgaacccatctgtgagaaaagtggataatttatgtgaataatgtaatgatgctgtattctcctagataatattatactgtttttgaaattatctcctgcccccattccaaacttattgatgaatggcactgtataggagtatcaaaaaactaagtttgcagattcctgagactgagtatagagggctgatgttaatcataagaagatctcatattgaaacagaacaactgcggtaaatttggaagagaataacgctttttttttttggagacagagtcttgctctgtcacccaggctggagtgcagtggcacaatctcggctcactgcaacctctgcctcctgggttcaagtgattctcctgcctcagcctcctgagtagctgggattacaggcgcatgtcaccacgcctggctaattttttgtatagttagtagagacgagatttcaccatgttggtcaggttggtctcgaactcctgacctcgtgatccacccccttcagcttcccaatttatcacttctttggaggccaacaaagtgctgggattacaggcgtgagcccccacgcctggccaagaataaagcttttaatctttcccctcccctgatctctttgctttctgaaataatctcctcacaaggaggtgaaacattgagtggccagcctggccttgctgttgcttctgtatatcccagcctgtcactcttaggagcacgatgaagatctataagtatctctactttggtccagctacacctccccttgaggaatatagattggaaagggtacagaatatgtttcctcattggtaatgttaaccttttatttcttctgaataatttaatatttgatgtgaaaggctattttttgaagtatcacataatgaaacaacagccctgaacaatatagacattagaagcatttttttcttttaccttactacatgcgttaccaaggaaacaaaagaaattggaaaacaaagaaaaccaaaggagatgtagcaatattgggggttataataactttgtgaaaaagtttcttgcagaggtaagttcagttaaggcacctaaaagcatcttgacaactgataactcacactgcatggtggatacaaaatgtccaatgaaattcccaagattttttaaagcaaatggtgtctgtttctcaccaaggatgcaaatccaaactgttatccaagtcttgttcatagtgctttctaaatatctccagaatgcattgatctttattatttcttgatctctgttgcgctttctcaagccttcacgacagtgtatgtcttccctggattactgtgatgatctcctactagactccctgccctcaatcatgcctctgtaatctgtagtgtgcatggttgtcagcaactctgttcatggccaccatacttaaatttttaaatttctcatgtttcagaataaggaaccctttaacttgacatattaggaagacgcttcatgacctaattcctatgtaatctttccaacatcatctctcacggctgtcctgccttatactagatgtgtcaaatgatgcaattacttcatttgtttatctacttagcaaatattgactaagcattcaacattgtcaggcactgtttaagtgttgcaatataatggtaatactttcagtttctagaataagtcctgggccttatctcttatctctgggcctgtgcatatgtttttctctctcccgggaactctcctcttccttgaaagtataaattctgctaagtgcgctactgccttacttctggtaaaccttctctattacctaggctgaattaggtgacttgctgggtcccctcaaaatacccttctctctcatgcatttatcatgctacacctttcacttctctgtctgctccactagagtataaacttcttaaggcaatatgcctttttcatttttgtatttccaagactgtgccttgcatattatagatgttatttatgggatatcctctgaaaaatctccaagtgagtcctaagatcctagacattgcctagtaataatttttccttcatgaggtagcagatggatctaatctattttttattttattattattattattattattttgagacagagtctcgctctgttgcccaggctggagtgcagtggcacgatctccgctcactgcaagctccgcctcccgggttcacgccattctcctgcctcagcctcccaagtagttgggactacaggcgcctgctaccacacccggctaattttttgtatttttagtaaagatggggtttcaccatgttagccaggatggtctcgatctcctgacctcatgatccgcccgccttggactcccaaagtgctgggattacaagcgtgagccaccgcgcccggtatttttttattgtttttaaagtgacttatgcaaaggtggctatgcctttttataaaagattagcacaaagggagaataataacatttgcaaattatttgcttgaagcttttatttagaaatctgttacatgtccttttttgatatatatatatatatatatatatatatatatatatatatctctatagatctgtagctagattagggagaaatttgggcctaaatttgaacttttatacaccaattaaagcaagtagaatttgtaatatatttcaccacaggccacaatttctgccctggagaaggggtcagatcgtggtctccatctaggggagcagttacctgatagtcacataaactgcaggtcaggcccctctgtggtctgcccctgttcaggttggatttccaagaaaacaggctctaaggagaaggtttgaatatggagatttatttaggaaggctcttgggatccatccttggggtgggagtgaacagatggggatagagcggagtaaaaaaatacagaattgggtggagggagagaatgaataacaacgctgccataataaacacctcaactaatcctatggggaagactggggctgggatgaccccagctttgagaggcaaagggggctgtgcctttatgctcctgcacagaccagtctcccaaccctacccaactgcaacttgatgaatgagggccctttcttcaactgtggtcaattcccaagaagggaatcagatgagtactgggggagtgctatagtttgagtgtacgtgtccctccaaaattcatatgttgaaacctaatcaccaaggtgatggtattaggaggtggggactctgggaggtgattaggtcatgggggctccaggtttgtgaatggaattaatgcccttacacaagagacttcagagatctgcttcccctttcatctccttcatcccttccaccatatggggaaacagagttcatccagtcctccatgttaggatgcagcaaccaggtataatcttggaagcagagacagaccctcaccagacacagtctcctgggaccttgatcttggaccttccagcctctaaaactgtaagcaataattttctgttatttataaattacccagtgtaaagtattttgttgcagtagcaggaatggcctaagacatgtagtgagtgtttcagttctgaaactgcaagtagagatcctggttgtggactctaagttcctaaacctcctcatcacttattgggaaagtcagttttggggctcaggaccattaggaaaattcaagattcctgcctcattcaaatggagggctaaatgcagggtaggaatagcaagaaggtattttctttcaagcccatttccctcttctttcaggctgttaaaacatgttcacttgttcacctgctagtggccattggctcagggaaagtgaatcagatcccttgttcaaggggataaatttagttactcttagccaatcatggtgattctattctgcttttcagagactggtttaacaagagtcatgtgatctttctggtcaatgaaagataaggggaagccagcctggagttgcttcagaaaggctgctcttaaacagaaacatatttgaagaaacagtaactttattctgactctttatgtgtgtggcggaggaagtgatgcctagagctactacaggcacttaggccatgaggagaaccagtgtaagtcagcaagccaagatgctaaagacagcagaataagaaaatggcaagaatcttgtccttgatgctgttgagctactgaattaaccagggctgcaactccctgtattagtaaggattctccagaggaacagaaccaatagaatgtatatataagtatataataaggaattagctcatgcagttacagaggctgacaaattccaatatctgcagttggcaagctggagactcaggagaactgacggtgtagtctaacggctagcaggcccaagaaccaggaaaagctgattaaagttcaaaggcgggaaaaaaaaacccaatgtcccaacttgaaggcatttaggcaggaggaattccctcttatttatgagactgtcagcctttttgttctatttaggctatcaattgttttgatgaggcccacaacattagaaagggcagtgtgctttgctcagtctatcaatttcaacgttaaactcatccagtataatgtttgatcaactatctgggtatgccatggttcagtcaacttgacacataaagttaaccaatcgtcaaaaccccctacttttggtttcttgataaataaaataatatttatcttctgttttagtggaataaaggtatggaaaacgctttgatcagtttctgtcttttgttgatctggaattgcagtatcattgtgattaaagaaactaaaatacagtgtaattaggggatcacatccaaattttgcaaaccctttggtaatgtttagaatatatttgattaattcattttcaattcaacaaacacctgttaaatactaactatatgtcagctaggtacatgttatatgtcaatgaaaaaaaaaagaaaaaattccccttgtggggctgacatctagcatataaacaaatggtcaattttaatatagttttgggtttatttaagcttattacagaataaaaaaatagtgccccaaactgaccactcttgcatagccatgcccagcagccaatactacataatgtcaacctacaacacagcaccatcaagttgttactcaaatgagacctaggcttgacgggatgttaggaggtccatttctatcaatcagagtctggagttcatccatcgccctaagcctgctattgagggagccctatgtaaacatttatgtggccaccaataaatagtaagcccctcaatcccaaccctaacctcactgtgtttctagattcttgcctctgttctttgtttgcactttattctttgctggtaacggattctagccctgaactccagccaaattgtctgggcctacgaattgactagtcttgccaacctcttctctctgggggatctggatcctatcccaattttctcccctctgcagcccactggctaaggccctattacaacccagacaacctctcccattccgaacataaaactgtcatctgttggataataacatttcccacataaccagttcctggtgccatgctcccacctggcttgagatggtgactgtcaccattaatctggtttggattcaggtttggtatgtcctgttagatgctgagacttgggggagcttatagtcatatacctcagacctcccctatccccaccagtcttggcttacttctctctctcctacagatctacagctggggttctcttctggctctcctgccaaggccaatcagatcgcaatacaaaaaagtaacactttccagcattctgtagagtctgattttctaaacagttctttagattttaatgcatctcaataatagttataagtaacattttatttttttctgtggcagattaggcctcctgcaaaatagtcattttcaaaaattgtctaagattcagatgccgcacccaatgtttatgctttttgcagcaatatggtcctaattcaacatcatgcagcgtgcaaatcagtgtttcttctaacttcaacagtgataaatatttattaagcctccactatgttcatggaactataccaggtgctgctataactatttttcctttccaggaaaaataaattcaaatatggaataaaaagcccaaactcatgaaactggactgactttgcttcttaaaaattcaacatgctgcagctgcatgcttaaacctggttcaaacaggatgatgaaataaaacattattattgtgggaatataacactgtctaaataaatagccaacatgaaaactgtctctaaaacccatagcatctgtatgtgcagactgtaagtaagttatataattcctccactattctgtaacatggccaattcagaatgtcttaccattaatcttgaagacatttaaagatgttcacttttctaactcttccctttgaaaatatatttgaaccttatttgcaataaaaatctcataatattgtattactttttgatgtgtcatttctgttaaatggtgcctggaataaatcagctttgacttttcagattacatgtgttgttccagagttttagtagttacaacatacatttacattttctaatgtcctcactataatgaagataaacacaggggtaatttttctcatgtcatgtgtatataggataagattaccaggccaacagtgtcactatcagatttctttcagaaagtgtttaatgttgaattttaatcacatgcttgaacaactaggactttttgggttttatttttcaaatatgtgttagtaagaaaacagactgaaatgtggaatgtaccagataaatctctttggtgattttacatatctgtatgatcatgtttgacttagaaataccaatcttttgatcttacacttcaaatgttacatctgtgaacataaaaatctatatggctataactttccaggaagaaatcttgctcaagtaactaataaatgatccaagttttagataattctgacataattccaacatatttcctacagtattttgctttagaagactttctgacccagatatttatggctaaagtccatattttatagatcaaatgataattaccttgtagaggaaagcatttgtttttgaatagtgccaggagcaagtaagtgtaactaatattacacgatagatatttctgcagataagtgagcttaactctcgtggttaaaacttatggttaaatttccacagattagtaaaagttctcagttttattaacaattctccattttcattaaaagccctactttcctgatagttaggctgatgagaagttagttcagagggctgctcattcccatattcatcactttttattcagtaatgttattttatgaataataattttcttatttgttgaggcgtatatcatgatgtttagatgtacattactatttgtccaatgcaactaattagttaaataggaatgagttgtaatgatcagaggtaatcccagaaaatattttttcaagtttacaaacttataactttataactttacaagttataaagagaccttcataacagttaattaaatcaaagaatcctttagttggaccataagcactaacagtcggcattccgtgaatatttgttatatgtttggtattttgctaagcacttcattttttttaagtgtcatttaattttcacatgaaccctatgaaatatgtatcattattagtcttatttaaatgttgctgaagctgatgcttcaaggaaaagtatcatgcttaaggacgaacagctaccaggtggggaaccggggacctgaactgggtaatctaacttaacttctgcttcagtatcattttagttatatctttcttgtacaagtatgtctcatcttccctgttaactcttcattgataggaaagaccatctttttttaatctttatgttccattacttgccttgggcacagtagagacctataaatgtttggtgctcacatttaataaaaatgtagtaataatagcactatgatatatagcaataatttttttttttttactttttaagggttaaatagggtcaacgtgattgactcacttgtttttgcttattgtacttaaacgtctaatatgttagattaactctattattaatgatttggccacgtaaagtcaacggctattctgaaataaacaaaatggtctgtaaatcccttggtatatttttgctgccaaagagtacaaacattcattcaataaatatttattgagtagaatgaagtgaaatccaagtgcaagaaaacagcaaagaagtaacagaggtgattgagaaaatagaaaacagtagtgagattcagaatgacagcagtggcttccactttagtgtaggtagttgaaaaaagccctaccacaaagttaaacttcagctgagactagacgggtgaggaggacatgaacttggccagtttgaaggtaaagatggatgatgtggctggagtatagtgaaattgtaatttctaccaatctaaaatccaaggcaagctttgcctgagccattccagacttccctggtggatatgaattagatcattccaagtcaaatgttcatgtgttgaaatctaatactaaagatcccttaaaaaatttttagactaatttcaatgaccttccattctggtcacttaggataatgggctaaaatagaaatccctctgaaacattattctctcttactcttatggttttctgtcttctctggatcaacacgaatggtactccctccactgccccaaatattttagccgcaacttggaagcccatggcacatcctgtgtgtattaaaagagggctccattgactacctggtaatgacagatgcttggttctccttggaaaacaattcttctaggtcactcactttctccattcaagactctgacacctgggtcacaatttcatcctctgctaaatcctgttattatcttccctgacttcaaaggttcttccacctctccaactccagtgattttcacatacctttgtcaccccacaaaatactggcaactgtggatatactctgaactttgttattccctacaattgtcctgccctcttacttccagctctctcctcagaccttactctccatagatgtctctctgacaccacagacatctcttatctcatggctctgttaccccagtttatctaccacattgttcttgtttatatccctccccagcttgaaccctataacttattgatggaaccacttttttgtaccaacatccccaaatctctgaaaccttggactttcctatgcatataccttggctgttgaacagtctcagaaaaaggtcacttggtatttgctaggggccaatataatatttaacttagctggagtctaatcaatgcttgactgtcctatgctttgttcttggttagtaattcttgccacccttcccaagaacttctttagattcctgccattcccccttaagatcctttttaactttttcttggtgccttggccttttattctactgacaatattgagatgttgaagaatgaaaactttcaaacacccataccttccctcaaattttgaaccagaatcatccttgactctctcccaccaatctcagtggaagctctcttgccttcttcccaaggccaggccttccagttaggatcttgattaggatactattctgtctgttctccaattttcttatatgccttcaacttttctgcttctcttcatctgtcttttcttaaggcttatggaactcccatttaaaaaatctttgaatttgtgtgcccctttaatgttagccatgtctgtatcagctaacctttatcagctgttttcagaaagaatagtctgcacttgaccaccaccacttcttgaattccccattcattcacctattaaaatcgggcttcctcctctatcctctgcgctgacaatatctggctaaccataattgatcttactatttttaaatccatttattttatttagcatactaacccatttcttgaaaccacctctttatttcattaatgccctcttctgtcatcgaaactctctgcctattgcttccttgtcccctttttctatcttttttctttgcataattcaaaatgctggtactcttggaggtcttttttcagcccattgctcttattactctgcatatgcttcttcagataggggcagacaggatgtggttctcatttaatttcacagtatgtattatcacctataagttgacgcctcagatctgctcagcaacttaggcttccaattggaaggaccataacttagtgaaataaacatactccaattactgaaaattttctacaccaggttcccctgccactctacatacttcctcacatgatggtgccagcatgcattagaaaccaaagccagaccgcttggagtcacttgaaatgccttccctcatgctcacctcatttagtcactacatcttgctgatttcacttctaaatattgctcctctgcttttcctcctactttttagctttgctgttactcctctagttcaggcattcatcttcactcatgttgattattgttttggcctcctttgtctgcctcatcttttctggctttgcactcacagtccatcctccttcttccatcatggctgtccatttaaagggcacatcctcctgtagcagagggatgacaaaaaaaaaggagaaggagaagatgaagaagaaggacaagaagcagaagaagcagaagcagcagcagaagaagcagaagcagaagaagcagcagcagaagaaagaagaggaagaggaggaagaagaggaagaggaggaagaagaggaaaaagaagaggaagaggaggaagaggaagaggaggaggaagaggaagaggaggaggaagaggaggaagaggaagaggaggaaaagaggaagaggaagacgaggaagaagaagaggaagaagaggtagaggaagaagaagaagaagaaagaagaagaaagaagaagaaaagaagaagaaagaagaagaagaagaagaggcaaatcccataacatcactcccctgattgaatccttaatgggtataccttcacctgcccactgctaggtgctgcccactgccaggtgccccatgcttctcttcacaacagttaccacattgattgcagtcctgttgcccagatgtagccagaagcacctcagtggccaacaccttgcctcactcattctacagccttggtacctgggatactacccagcacaccataggcattcaacaaatgttaaactaaacagaatagagttaaatggaatatataaccaaagttaattccatattggagaaaaacaaacatcatggcaagtaattatttggggaacacctaatgcataccagcactgtgttggaacttcacacattttatgctgatttactagacatctgtgttacacagcagggtgaagtggtgtaaggaacatgactttttaaagagaaagatcttgggttacatcctgactgtgccacttcatagctgtgacctcgagagaactacttaacatctaatttttaatatcgcactattcaagggatagcaatgcatttctcacagggtagttgtgcagactaaaagagattaaaaggacctagaaaatgtgtggaggttaaacatgaatgccactggggcttgaacctttctcataatttgacaactgctgagaagggcaggactttttggcatgttaaggtctctgagttcaggaatgaaggggcccccatgagtcctgagtgagacttgctgaggcccagcgatattgtgtgaaacaggatttaagagtttttactttccagaaaccaagggtaacagaagtctctgtattgtaataggaggtcatacctgcttaaatacatagatagtaatttagtatttgctggtgtaaatagtacagtactattggggatacattagaaaccttaggaacatttattaaatgaaatcataatagacaaaacccttcagagtgtgccatctcttttttttgctgtgacgctgacagctcttacactatttcaaagagatttggaacaaattattggtaacaataaagcccctctaaaacttttatatggagatgtttattgcaacattatattcaatagcaaataattacaaataacttatgagatcataaagtaaatgatgagtgatgttataccaatatgataaataaaatattatttatctctacagtaaggcttatgaagactgtaggaaatagaaataaagtgcccaatgtggcatgcatctaattccataattatagctaagaaaatgtaagactatctttggataagggctaataaaaaaaaaataggtataaggtagtatgcaaatatgaatataattaggtttgggcagtaaaatctactgattttttttaattttggaagtttacataattaaaaattttaaattattttaaatgatttatgagcatcagtatcagaatattaaaaatatataaaccaagataaatgctccaagcaagagaaaagcaattactgacttaccaaattattcttctgacatcttaattataaaacctagccataatttattaccagaccctagcttcccattcttataacacagaaaatattattttatgacttacaatcaaggcacaatctcttaaataatctactttagaatcaactataagcaaaagaaaatttatctacagagctatattattagataacctggtttgtagccttgcaatgtgtattcaattgcctttatgtctatttgcctatctcctaaaatactcaaatttcggattttagcctaatacactcacaatcatgagactgattacataactggatttcaaggagaaaaaataacaaagaggaatgaattaattatctgaactttagttatatattagatttcctaaacaagaattacagacaaatttgtttattaagaaaacactgttgagaggaacatgtctttggaattatgaaaaatgatcttccagagtatatggaaagtaaagacattctgaggaaatgtccattatgaaagtccaagtgactatgcttaaaccactataaccgtagatctgattgcttgatgctataattcaattatcttctcactactttacctctcatctgatagtgaaatacagccctattttttcctctagtatttattcaaatatttttccaagtatgacacaatgactttatctcctcagtcagttgtcattcttgaggtatgtagactcatcaaccactaaaccactgtggcgaggaccctggtccatttggccaaaaattctgcccttgttcttcatcctattaaccgtaaatatattaggaatctagctagaagatgtcccaatttattattcattatagctctaacaatattaatgttaactattaagtatgaagatgatttttttttattttccattaagtcatttattgagtcacttacattatgcctgtagtttaggtaggattaatccataatttcttcccaaattcccctgtgattcgattccttgcagaggaccattaaatatatgatgagtggttggaaggttccttcttatcctatggataaaaggctctaaatgtcttaatatatttaattcttcatttaaatcacttctgatgtgtgtttattatataggtaggctctcttgaacatatagtccagtgcaactattaatgctttatttattttttatttatttattttttgagaccaggtctcactgtcgccaagccttgagtgcagtggcaggatcacagctcacggcagcctctatcccccaggatgaagtgatcccctttcttcagcctcccaagtagctgggactacaggtgtatgccaccataccgtgctaatttttgtattttagtagagacagggtttcaccttgcccaggctgatcttgaacttctgagctcaagccatctgcccgcctctgcctcctaaagtgctgcgattgcaggcatgagccaccacatctggccaacactttattgataactgtatgtatgtataagcatttctaggttgtaacaatccattggctctcagtaggcccaccagaggagtactgcacctgcaatgaaaacctgtctcagatttcaatctgcaagtgttttattatgggctgctagtaaattatcccacaagaggtcgctaaagctccggtttttttgatgtgtgatttttctgactttttctccttcctgcaaaggaattgcaaaaaattttctgtttcccggttttctatttcccagtctgttccaacttgacatgaaggtagtcaagaattagggcttagtcatgggcaaggcagcttacttatggaagtttgtagccatctagggttgctcaaatccatcacgtgaacttcagagcatttcttaccacaatttatacttgaaaaggaaatacaaccaggcaccttctgacctcaataactaaactcttttagctgtaatgtagacccctttaaaggcacattaccacttttcaggccctgggttgacattccagttttctgcacataccagaatgatagaatagacatctaaaagaggcctgcactcagtaaatatctccttagagaagatctaataaataaatgctagaggtaccctcattaatggaaaattgctgctacatctatttctttggaggatttttagactcaagcaggcagattcctgtaaagaatttggtttaaaacaaagctgatattttagaaacaatctctattttctccacagaaaacataaatattttttaacaagacatttaaaattgtgttttagagaaaaatcggcttaaaatttgagaatattttcgcccatccttagaagaattttctcttccccttagaaaaatattgcctgaatataaaaagggaatcttaccttgatttctccatctctcaaatctcagaagaaacaatgccacttttagcattcttgactagtaagattattggctatatattttcttagcaagggtcacatgttacatttttaataggttctattacatagggcagaggttataggcaaagacttctctaatgatctttccacttcccttctctacggggaatatttaacttaaaatattgtgatttaatcatatataaagagagaagtgttattgtgaatcaagcatttgaacaattttatgttttcatatgaatatagagtgttaaaattataaataacattttaattatacggatggaaaaacctggaaagatctcaaccctatgaacatgaaggatttatacaagatgattttggaatcatcccttctagtcctaaaatgtaatgactttccttaaattcttatgcttttggactataaaagcccatttctattttaatgagataactttaagtggagggcttttcttatttgaatagctgtcctgttacgatttgggagttaaatatcagataattaaaatttagttgtttacagttactgagatttttgcattatttcctcagcaataattttttatatttacaacctctatgttaatgaacacactatttcatgaagtgcttttgtaaaatgctaacataattctttcctcatgtctttttggaggtaggagactcatatactttttatcagagatgctcatgaacttgaaggcccaaatgaataataatatacagataatgaatttctacttgacttgagccatatcgcaataaagaaggaaaaatgaaacaggctagccaggagggtaggaatagaccagtcacaatgcatcaaaaggcaaatgatagtaatcagaatctcaaagaatcatacaatgagtctttttaaaataccaccaccacctactccactactctgggcttgtgttagctgacaaggcacattggttttcccgtttactcacattaagccctgggtaggcacaaccagagaacatttcaaatatgtatgggttatgaataagtgtgagtcaccgacttttagtccagctgaaactacattgtcagaagagtattaagctggcatttgcaacccacatacttaccttgtgcctgacactgtgttctgtatttaggacaaaggcttttctagtccatgcactcaggtaactcacaatacagttgaagaaaagagataagaacacagacaactacagtattgcatcagtactaaggcatgcatagcacccccacccccagctgtcttacctcttggaaatcaggttgcatcttacaattgatggtatcttgcaaatgccatgtctaggctgctgtcataagcagtcttggtttgtgtgggtgcaaacttggtcatagctgttgatcttgtcttcccttcattgaggtatgtgcactgttgataatgcatgagttgagtgaattgccatttaaaatgctttaaatgttaccttataattcagtattagaaaaaaaattgtggtatgtgcaagaagggctagaaacagtgcagtgggatgtatatttaatgtcactgaggtaaatatttaccattggaaggatgattctcatttcttattttcttgcaaacccataataaaataataattatgggttctaagaaaggaaaatacatgttgaataagttgtgtaaaatgtggtgactatgctatgtgtcaaaggattgtctatcaccttgctacaaccaagtgtggtctctggatcaggtacagtctctgcatcaacattacctgagaagttgttagatttggagcatctcaggcgccacaccagacttacaaaatcagaatcttcattttaaagtccgtaaatggttcatatgacataaaagtctgataaataattatgtcacatgccaagcaattcaatgaaagtcaggaaaaattgcctttgaagagatgaaagaaatttcaaaacaacaaggagttgatgtgaccaattcactcatgcaggactatcattaaggtgtcaaacttcaatatcagaaacttcctgctgagtttgaacagcagttgcctaacttcgtgtgacatgtattttgattgaagaaaaatgaaaacgatcagtttattgaataaaaaatgctaacaaaccatgggctctttgatatgtctcagaatcacactaaaagaaccctttcaatacatataaaataaaaattctaagtgataaggctgtgtaataattttactggcagctttttttgttccttgatgttacataaactaatagtgtgttttataattgatggtggcatagacttgatgaaaaacagtataatacagtgtgataggtgctataataggaagaagtgggagatgctatggagtaaataggtggtggtcatatctcataatcaaggtttgttaccttgagcaaaagtcagtcagatggagatgggaatgaattgaggtgggatgcagggaagttattattccaagaagagagaattacacatgcaaagccatcaaggctgtttgtcaagaagcaggtagagggattgaatcagtttttaggggatgggggagttgggatgctggattgtgttttgccttagctttggtgttacagagcaaaagcaaagggaaatagtacctccacatgtcaaaggaaaatttggtgtccaaaagctcccattcccgctaggagaactgaccttgtgtattagggttctctagagggacagaacgaataggatagatgtatatacatacaggggagtttattaaggagtattaactcacacaatcacagggtgaggtcccacaacaggctgtctgaaaactgaggcgcaagaaagccagtccaaatcccaaagctgaagaaatttgactctgatatttgagggcaggaagcatccagcacagaagaaagatggaggctgggaggctaggccagtctagtctcttcacgttcttctgtctgcttttattctagctgcactggcagctgattagattgtgcccacccagattgagggtgggtctgcctttcccagtccactgactcaaatgttaatctcctttggcaacaacctcacagacacacccgggaacaatactttgcatccctcaatccaatcaagttgacactcaatattaaccatcacaccttgtctgggatcagttttgtgtagaattaggttcacggataaagttagctttgttctcttccagtattttcttgaatgaggatggtttccacttaaggaataaagacattagttttgatggctaagaatggagttttcactcaatcctgtctgcacattgccatcaccccaagtaatgccttagccacactcacagaagtttgattaacttgctatggagaagcatgagcattggtattttttatccattgtctccatgatactactgtgcagtttatttaaaaaaatgggcttatggtcagggagggttagggcagatgaacagctggtcagcagaaaacaggaactgcagcacctataaggctacaaatgaagcaaagcatcagtcaaacacttggcctcttaggggaaaccatttatttgggcagatatggtagggaaatgcgggataaatttctgccatcatatgataagccctaggatttaccaaacaccttggatcatcttggaatcctctcattctaagataacagatctctcttctggcctcctatgggtgtttggatataaaagacagatacacaactttcacatccaggccctcagatacacatttcccagggtagccctgaggtggtgctgctgtacttgtggtcacatcttggtttgaaaacgctggtagagagagtggaacttttcccttcttttcacaaagagtatggggcttttgcaaggccaaaaatagaaaaaaaaagcctaaagttggtgcctacatgtttgtgtggagcatttaagctcaaacagggcatatatatgttgggtaagaaagtggatattcatccataatgacagtatactggtgatatctctgctatgtcttgacataaataggattcctatagttttaccttgctcagttgcaggagtgggaaaggcagctgagtggggaaactgagtcaatatatacaatgttaacagtagacttttgagccaaaggatggggtggacacattcaagaatgaaaggaatagtgggtttgcaaccgtagaggctgagagcaacattaagtaacaagtcacagacagcactgttctctcaactccctctgtgcagtgctagtgtatatgagtgggggtcccctgataatgtctactcacacaggagccagcttgagtcagtggacagctgggctgaccctacctgcatttgtacttcaaagctatgtgatactttagtgtattataggctgcacttggaggtgtgttgttttgaagacagatttgtggcacaaccagtggaatattctctgcccaagagtggcggctgaggcatctagcttattaaaaaggcctccaaactggtctccctgcctccacccttgcccctcacaactctactctcaacaaaacaatagaaatgatcacttgagaatcaaactctgtcttctctactcaaaaacccttctatggctcctctactcaggctgaaagtcaaggtcagtaccatggcctctaaggccctttgtgatttgtgtcccctcccctactcctctgacttcatctcctcttactggtccacacttctgccccagggcctttgcatttgcttgtctttctgcttaaaatactcttccctatatattttggggagctcattcttcttctcctttaaatctttgtttgagtgtcatctttgcagaaaggctttccttgaccaccgatttcgatttaaagtgacatctgactgagccagaaagaaatagattccctgaatagataaataatgagctctgaaattgaatcagtaataaatagcctaccaactaaaaaagcctcaggatctcatggattcatagtagcattctaccagatacataaagaagagctggtattattcttacagaaactattccaaaaaattgaggagggacttcttcccaactcattctatgaggccagcatcatcttgataccaaaatttggcagagacacaacaaaaaagaaaacttcaagccaatatccttgatgaacattgatggaaaaattctcaacaaagtacttgcaaaccgaatccagcagcacctgaaaaggttaatccaccatgatcaagtaggcttcatctctgggagacagtgttggttcatgaataaatgtgattcatcacataaacagaactaaagacaaaaactacatgattatctcaatagatgtggaaaagacttttgaaataattcaacatcccttcaagttaacaagtctcaaaaactaggtattggaggagcatgtttcaaaataataagagccatctatgacaaacccacaacaaacatcatagtgaacaggcaaaagctagaagcattccccttgaaaactggcacaagacaagaatgccttttctcaccactgctattcaacatagtattggaagtcctagtcagagcaatcaggcaagagaaagaaatgaagggcattcgaatagaaagagaattcaaagtatctctgtttgcagaaggtatgattctatatctagaaaactccatagtctcagcccaaaagctccttcagctgaaaaacaacttcaacaaagttgcaggatacaaaatcaatgtacaagaatcactagcattcctacacaccaacatcaaccaaactgagactcaaatcagaaaggcaatccaattcacaattgccacacatacaaaataaaatacctaggaacacagataagcagggaagtaaaagatctctacaatgagaactacaaaacactgctcaaataaatcagagaagacacaaacaaatgtaaaaacatcccatgctcatgggtaggaagaagcaatatctctaaaatggctatactgcccaaagcaatttccagattcaatgttattcctatcaaactaccaacttcatttttcacaaggctaaacaaaattatttaaaaatttatgtggaaccaaaaaaagagcccgaatagccaaggcaatcctaggcaaaaagaacaatgcaggaggcgtcatgttacccgacttcaaactattctacaaggctacagtgaccaaaacagcatggtactggtacaaaagcaggcaaatagaccaatggaacagaatggagaccccagaaataaggctgcatatctatgaccaactgatcttcgacaaaactgataaaaataagcaatggggaaaagactcccttttcaataaatggtgctgggataactggctagccatatgcagaagattgaagctggacctcttccttataccctaaaatcaattcaaaatggattaaagacttaaatgtaaaacctcaaactataaaaaccctggaagacaacctagacaatactatcctggacctaggaatgggcgaagatttcacaacaaagacaccaaaagcaattgcaacaaaagcaaaagttgacaagtgggatctaattaggtcaaagaacttctgcacagcaaaagaaactatcatcaaagtaaacagacaagctacagaatgggagaaaatatttacaaactatgcatctgagaaaggtctaatatccagcatctataaggaacttaaacacatttacaagagaaaaaacaaccctatcaaaaagtgggcaaaggacgtgaccactttcaaaaagaagacatgcatatgggcaagaagcatatgagaaaaagctcaatatcactgattattagagaaaagcaatgaaaaccacaataagataccatctcacatcagtcagaatggctattattaaaaagtcaaaaaataacagatgcgggggaggttgtggagaaaagggaatactttattacactgttggtgggagtgtaaattagttcaaccattgtggaaggcagtatggcatttcctcaaagagttaaaagcagaactaccatttgacccagtaatcccattactgggtatatacccagaggaatataaatcattctaccataaagacacatgcacgcaaatgtttattgtctcacaataccaaagacatggaataaacctaagtgcccatcagtgactgactggataaaggaaatgtggcacatacgcaccatggaatattatgcagccataaaaaagaatgagatcatgtcttttgtgggaacatggatggagctggagactgtcatcgttagcaaactaacacaggaacaggaaaccaaatactgcatattctcacttataactgggagctatatgataagaacttatgaacacacagaaggaaacaacagacactggggtctacttgaagggggagggtaggaggaggaagagaagaagaaaagataactattgggtactctgtttaatacctgggtggtgtaataatatgtacaacaaacccctatgacatatgtatatctatgtaacaaaccttcacatataccccaaaactaaaataaaaattaaaaaaattaaaaaaattaaaattcatgaaaaaaaaagtgacacccaacacttcctaacccatgtcactgctttatttttctattttcttcattcattcattcataagttccatgagagcagggctttttctcttttgttttctgctacaggaacagtaagtgcctagaacaataagtggtgattaagaactagctccttgctgaataaatgaaagaatatgtgtattatcccaaaccataatgtttcttggtgtcagtaacactgggagtgggcactgaccacgtggtccacatgcagaatatgcacagctatcctcgctggtgaccttcttgctttgtggatgtcaaagaaagtagacagctatatggactctgccacctggataactctagaggtgagtggtaggggttatgaacagcactgaggagctgggagtggctgtttgttgggtttctagcttcaggacaagttctatgagtttcctgagccctcatgatctaaaactatgaagcatgatggtgctggggtgaatactcattgtgttgcttgctcggtactcactatcctaactttgttctgaaggacccatttctccctcactctgtgtgtttcaagtaaaatatgtactgaagaaaatgccacctatttttataaatactgtgaactaagaatgatttttatatttttaagtggcttcaacaaaaatcaaaataataatatctaaatttcagtgcccataaagttttattgtaacttagccatgctaatccatttatgcatggctgcttttgctctacaatggtggaggtcagtagttgtgacagagaccatgtggcctgcaaagccataaatatttactatctggtcctctatggcaaaagtttgccagcctccacctcagactgtcgctgtggttagagtcctatgatcacagtgggtggttcagcacaagacccaggtttaaacgtctggtcttttctttgaactacttgggaagctagctctagctagctagctagctagctagctcttctgctgcctcaggtgagaaactgaggatgtcaggaagcatcaggcagcccctaaggatgaggtcgtaatcaagcttgattgaaaccattccaactctagaattttcagctgtgccaatcaatacattttctttaatcttaaattagctagcattttaagatctttgttgcttacagccaaagaaacttaactgataaagtcatttggaagaaatcctactccaggtatacagggaacagaattaatgagttcccaagatgattgccttatggtggcaacagcagttgcctggcagaagataggaaatctgtcttaatagtgccttctaggacccaaatttgtcctgctctggtagaaatcctagaagatcaggaatacaggagatgcaattagtgtttaggatcttcatttaacagcacacatctgtgtcttcccttggcataaatactgggagaatgcagtactcaggatttttatatcctcttattggaattacccacataatatatgatttattgcctatagacttctcaatttctatgtacacaatagcagcactaccatattttttaattcaaatgaaatgcatgaagatgtttgggtagaagtaatagaaaagtttagtaatgaataatgtttcattattctgtctattttctgaacatcagtcattatcaaatatagactcataatcaaataataatacatacacctacaatattttgattatgatgtttttagaaacatacatctcttttccctcctactgattaatctccttgctgtttaagcagcaaagctgctttccactcagtatctcagggaaaggatatgacatggtagacaacagaaaacaaatgaaacaactcccccacactccccaaattcaggaaacttcctggcaaaaagctcactcctttaggacaatagagagtctctgggtagagccaaattatataagagaaacatcaagggtgactgttgctttcgccttctggagaggaaaagattcccaggggtttatatagaaaaggaaggggaaaagagggaacagggaggatgtggtggcagtgcgtttggatgggtttcaaagagggagccccagttccatcaaggaccttggagcccctggaggcttctccctcgggttctgtggggccaaggagaggcgtcccctcaatcccacctggattccctgctggatcagccctagaaggaagcttcctggggctgctcccacttctgcttaagtgtggctacaccgtggagggtgggtccttaggaatgtggcaagggcagcaagattgagggggccatagtggtgcgggcatgtggagggggcacaggctttggcccgcgggcctgtgttcctatccctccctctgtcgttccctgtgaccaatgggcggagggcccattcttggcagaaacccagggaagtggcaaaattcccagacagtgttgtgagagcagtagaatgttcacaacctcctacccttgccctagcatcagggtttgacagaaaaattagattgaatgaaataaaaatatttctcacccacttgcgttcatggatggagattgatgaccttctaggtcagacacatttgtttccattagtgtggaaaatcaagagttgacttcactcctcagttcttccaagggtgacagttaaattttggctgcacaccagcagccaatggcatgcaagtgttagagcaggttatctgcatttcatgtgctggattttgcttcactgcaatgcactattgttcattttgaagaactgctttttcttcatttgattatgaagtccattcttcactgagaaagggtgaatcactgggtttcattatggagctcttgaagttcagggagagcgattttcatactaagttcattttctttaacatataaccagtgaaataatagaacaaaaatacatttatcttttataattgtttccctcctctaagacataacagtattaacataacagctatactgcataattcttcttcaaccaaagaacaagaagattaatctattctatttatttataaaatctcctgatatttctgatactggtttttcccgtcattcacctggtggaaaaagcaaggtggggaaataaacgatggtgacagctttttgctggcaatgcagaatgaggcccttgatgttattgtggcccaagggaaagtgtgagtactatattcatcagcagttctcaatcgggctattttgcacattaggggctatttggcaattttgggagatatttttgattgtcaaaactggtgaggtgggtaaggtggaaggtatgctactggcatctagtgagaagcgagatgaagctaaacatcctacaatgcagaagatagccccagcccctggcaaatagttatctggcccaaaatgtcaataataattccaaggttgagagactctgatataaagtaatcaggaaaggaggaaagatctgagtatgttaggatgattggcagggtttttgcagactgagaagagccatatggacatttgttgaaaaagggggaaagagagacacctgaagagttggataattcttttatactatgtaaggcatattttaaagggctaccgtttttagagggtacgttcttaccaactttttaaggagaggataaaattctgtgaaatcaatattatggttattaaaagcacaaaaggaccataattgtttcatgatttgtcttgctaatttcacatactatgatgttttatgtgctgagtggagataaatgtgtaaacaaaaatacgaaggtgacaaagcatggtatatttctacctggctaggttgtataggccagtgaatgtctaggggaagggtggtcctggagccaggtgagagagatcttgaatggaaagttacagagtttgaatcaattcattagaaatggaggcaggtgtattatagggttctccaggtaaacagaatcaatagggtggggagggagggaaagagagagagagagagagagagatgagagagatttagttttcaattgagggagctggcaagtcctagatttgtatgacgggcaagctggagattcaggtcagagttgatattgcaatcttaagtctggaaactcttctgcatctggaggcagaattctttctgagggcagtgagaggcaatctattccatacttctcacccagcttcttgttgtttactgatcatttttggcgttccttgtagaaacatcactcttatctctgccttcatctcatatgatgttttccctctgtggttgtctgtgtataaatttccccatttttttctatagacaccagttatattggattagggctcaccccagtgacctcatgttaactaattatagcttccacagccttatttccaaataatgtcacattatgaaatactgagggtaaggacttcaacatatgaatatgtcagaggcagacagtttcacctgtaacagggggtttgcatagagcagtgacattttctgaattgttccatgctggcaacattgcccagttttcttctcagggacatcagttataggaaaatgctatagtgaaggcaaatgggacagaatcttaaaatatttgtgaatctttgttttttcttgttctaatgataatgtaaatgtagaaaacactaacacattgtaaaacacagaaagcaaaataggtattatactgctcagttatgatactgctcataacccaatttatcagtaatagtatgtctatatttaaatatctaaaaggactattttttaaaaaatatgggtcttgctactttgcccaggctagagtgccgtttggctattcacaggtgcaatcatagttcactgcagccttgaactcctggcctcaaacaatccccccacctcagcctctcagcctcacgcgcagctggggctacaggtacgctccactgagcccagctatggaatatctatttttaataaaaatgtgaatcatagcatacgtactgttctgttattatcccttgttttcttttggacattttggacaccttttcgtgtcagaacataaagacctactaattcttttttatttactgcctagtatttcattgaatgaatgtgctatatctgtttaaccaatcccttattgagtgccatttgggttatttctaaatttttacttttacaagaaatattacagtgaatgtcattgaacatatatctttgtacagtaagtaattttttttgctgggtatttttttttttgctgggtatatttttagggatagaattgttgagccaaaaggtgtgatcattttaaactataacagacatttcaaatgcaaaaatgctgcatcaaatttttttccctcccactaaaaacatatgaattagattagtaattcctacatagaaagaattaaatagactacactgatagtgtatttaatgacactatgccagcacaataattcctgtaataatcaaagaatagttaccattgttttattaatatacacttatttgtcctccatagagctcttgttaataaatcttagcttattgctaagatttgggacttcttccagatggagtttatgattaaatgctaatcacattgttaccgaagtgttcagctttattcattatttgtttgatgtttgccataaaaattacagcccttataacccattattttggtttcaacttctcaaaataaattgaaatatatgttaaaaacttaatgtttgattactgtttaaaatgctaaaaaatatgatccaaagtatcagtgcttagaactagaaaacccaaatagctttaatcctttttgggggctttcttttcacccccgtgatgtgtgggtgtgtcaaacgtggattccttcctgttgttctgtttgctggagcaaagaatcatgtcttgataaattcacaagactagtgaatttcatctagtgtaatattgaggagtccagatcatggagaaggtgtggctaggactggtaccccccaaatactgtcatctccaatcacaattctggaaaacagtttgatataagaacatcaatgaaatggtaatttattacaccagtagagtggagctcagctatggagacacaaagcctggtgagacttggaaatcctgggcttaggccgtcagtttctggggtctgttaagaggatgcagagtgccagccacagagctgagtgtcagagaagggctatagaataggggaggaggaatagaagagccacttggtgttcttgttgtaggaggcacattaacacatcagaaatgttccaacagagaccaagctaacaaactggagaccatgaaatgcagatagtctctggagactacacatccaatgtctgaattttctaatttacttttcaaggcaaagtcattgataccatgtttttctccacaatatttttgcctgtaccaaccaagagataacatacggcacttcctaaaacaatacgattgccttctggattttcttccaaatcagtgatacctgttctccaagttttgatgatgacactgtctttagcttatcagaaggtggccatggaagatgctcagtcaacgagcaagattcatatttcttcctgaaatggttttgaaatagttgttgcgggaaatgtgaagggattgtggtcatgcagtcatgtcaccagaaataaccaaatttatccgcagctgttgtcagatacaatcaatagcaagataagcctcaatttcaaagatattaaaatgtgaaacttagaattgaatgaattattaaaatgtgaatcttagaactgaatgaaatatagtaatgtgaaaaaatttaaaatcgaatagagcttttttttaaaaacatggatcttgctgtgttgctcaggctagagtgcagtggctattcacaggtgcaattatagttcactgcagccttgagatggcttcattaattatttcctttaatcattcagcaaatattcactgaacatctttatgtacaagaccttgtggtaaaacttgccacccatttttatttgttgcttatgcctccttctaggtttcttaattagcttagctaatagtttatgaaatgtattttttattccaaagactgaactcttctatttctctattagttctgctattttctatttcattatttttgttttaattcttgtttcctttcttttatgtttttttacaactgtttaatttaaatgtcttataaacttagttgtaatcttaattatttagatatataagtatttaaatacatacatttctctctgctctagccatatcctattatttctattatgtggtatttgaactactggtatttcctagatgccttactattttgatttagagtttttcctttgatgcaaaagttgtgttagagagaaattaaacttacatgtagcagtatattttgtttttctaattttgtgattaatttctatatttgttgtagtagaggatgttatctacatgatttttactttcaggaatttattcttttttttgtggtttgacatatggtcaattttgaatatgtttaatgtgtaattgaaaagtgcgttgagtttgatttaaattaatgtatctatcttattgattaggtcatttggctcattattttttcttctacttaatctgtatcatgaagagatgacttcgtctcccatatttacttgtgtttctgtgtttctttttgtatttcttgtttctatgaatttttttattatttgtgcacaaatactcataactgttagatttttattgtgggttgtaggaattgttccaaagtacctctctttgtcatattttgcactttgtgagttgaattccacattgtctgatatcactatcttgaccctgcttcattttgtatttgccaggtaggtctttattgattctttcaactttcccatgccgctttgtttcaaacttagcttttcagtacaccatgttttactctgtgatctctttttcttttattacctttctatttattttctctaaaagatatagtctttggtttctaataggtatttttaatagcataacatagctacacagagcattatttagactgtacatgagttacttgttttaaacaacaattatcccttcttcccctgacccctcaccctccctcacaaccaccttcctatttggatgagtcctctgtacatggcatggccaatggagtccacagactgacctgtcactgccatggccacagcagttctacattcaaatggattcatgttcactgcctccacttttgccatagcttcttcttccttttattgaatggttgaagtttgtttctttaagaagtcttcacgggaccatagttcttaaattcatccatgtttgaaaatgtctactgtttgtctctttatgcctggagaacactttatgcctggggaaaactttatgcctggagaactataaaaatctctgaagtgcataatcatttccctgaagacttgacagaaagttgaaatttatctgatttttttcccttatagatgaccagattcttcctttatctttgaaattttatatattcaccagaaaagatacattaccagtttgatcgctttcatgcatttttgctgaaacatcatgtgacatttgaatttgtagattcaaatatttatttaaaaatgatttttaagttatatttttgagtacctttctgggtcttattgttttctgtttcatggaccctaaataaatgtatacttcatttcttttgtctgtcttccttccatagctttactttcctctctagtccttttaaactcttttggtttggcacagtattctcaagcttgttcttcaggtccttgaatttgttctatctgtcctcctttccgtgatatctaaatgtgacattcatttttgtgatggtcttattttccccttccatttccacctaagttctagcatttacagaggtggttctttcattaagttctcctatccaggaggacagtttaaagttttcatcagcttcatgacaatacatttgaggtatgtgttgtgggcttgtatctatttttggaagaggttgtatttcttttcttttttaagagtgtttttactttgatctcatgctttaaaaaatatctgatctttgaatgagagaaagtctttttctcagctcttagttgaactatagaatagtgctattttaccctaatctgtctctaatatgattatttacaatggttcaaatgcattttcagcagaaaaattgtttttttgaataagttccaaacttgctttccttattaaaagaagctagttggaacttgggtctgtgtgcttaatttttaagcaaaatggagcttttgctcaaaatggagcttcactgctttcattggttataaaattgaacctcatgggaagtgtaaacataaaaagcataaagaagaaagcaagaatcacccataatttttaccacttagagataatcaccatcattttgatgtatataagactgtaatttttaaagtatgtaaatttatgtgacacatgtttgtatatatagtgtgtatacacacatacacagataaatggcagatatttgcatgtgtgtgtatacacacacattcatacatatatgtgtacttagtatatatatacacatacatgtgctcatactatacatacgtaataaagtgatctaactttgctttttccctaaaggtcagagctgatgttctcaaaccttgcacagaggtcagccctagggcacaagagcaaattcatagggtgggtgccatgggaattgaaaaaagttttttctttattttctctaattctgatcctgaccctgaccccaaaccctaaccttaaccctaaccctaacccctggaattttaaaattattgagaaaaatatagtgaatgctagatgaccagttagtgggtgcagcgcaccagcatggcacatgtatacatatgtaactaacctgtgcaatgtgcacatgtaccctaaaacttaaagtataataaaacaaacaaacaaacaaacaaaaatatagtgacattgatatcttttagatactttttgagatactaaatggaagtagttcattttatagttctgtctttagattgagctatgttcctttcaatgatgttatctttgcaaatctgagttgatgaaattaaaagcaagtaaataccctgtgaaaattatctgggaacaggaaacgagggtggcagtattcattctaagtccaaggcttgagaaattgtgcagtgcccaacattaaacagatcccattaataagtaatttggttaagaatgacataaaaataatatttcaatttatgtgtattatttctttcaagcatggaaatctgtgcccggcaaaaccctcaatcaaatatatggcataaaaaagatatttttagacccctaagatcttaaaacagttacctctcttctaattggtctaaaaactttctcaggaacctgttggagaatgtactccttggaaataaggaagaaagaggatccagggaacaggagtttcaccacagaggagcaggaaagggaattcccagtatgatggcaagttgctaaattaaatgttttgcccattattttttactgggctgttggtctttttcttattgacttaaagaactctttattataggagataaacctttgttgtgttgcaaattatttcttgaaatgtttttacctcttgaatttgtctttgagtttcttttttctttgctctacagaaacttaaaatatttatttgatcaaattgattaacgtaaggataattttaactctcagatcctgtgaccctattaagttagatactataacttacagaaactaagccagctgtctgacttcttcggactttagatttgttatctgtaacatgacgagtcttctgctagctatttgtgaagtcccttccaactgtgattattgatcagtattgacttcatgtgatgggaagcttttgacaacaaatttaaattagctcctggaaaaattctagaaacaatcaacaacaggattttagataaaaccatgatattaaacatcataaaaccacaaaatatacagattgaagtggcagaaaaattcagtgactactgctgagacgacatggagaaagaacacttcctcattttgtctgaggcctggtgattcaacggctgtgtgaacggaaggtagggcatcagcaggcctggaaatatcaaactggtctctaccaagcttctcactagcaaaaaggaaagagacgggaacttgttgaaactccccctgcagcatgttttggacacaaacatttcttattgtttttttttcttttttttttctgtgagtgacaactcattcacaaaagagaaaggtgaccagagagctttgaaactcattcacaggctatagggaactttcctcactctctgagctcctccttagctcaggtaggagatggggaaggagtaggtgataaaagggagttcatattgccatgcttttgcaactctttccccttctccctaaattgctaccccatggaactttggttcatctgctgtccttatgtaatgctctgatctggatgcagctttcattagcaatatctgcaaacaggaatgagacattgcatgcatttgttctgaaatgatactaattttaaaaactatctgcaaataaatacaagtgcttctcaaccagtgtacatctttcacattgctttgtccagaacatgatcagtgaaactaaatctctagcctctgcactagactctttttaaatttttcatattttccattgctggttagtatttgttctcacatgtatatagagataaaagcatcacagctatatagcttgtgaagatttcgtttggccctgttgaaaattacacagtcagaaccatttcattagtatcaagcctctgtcaagatgtatggttagaaattgagtaagcttggaaatccgttgtatttgcacacatttgagacatccagtggggcaccagactataaaatagctggcttagcagactaaatggagtaaatgcattaggtttttgcatttagaatctaagagcatttagaatcatcatagatgagttccaaatgagaaaaataatatatatgcatttaaagcaaactaaaacgtattagagaaactctatgtgttagagtaaatattttgatagtcattgtaaagctgttttaataatgattttatatggccacatgatgccaattacttaaacatgctagatatctttcattgtaaaaataatgcaaaaatgttacaaactattcaaatataaggaagaacacagtgtgactaccttaacacaccgttgtgtacatttttctgtccatccttacaggtatttgccttgtgcagattttttacatagttgtagttgtataattcaagcacctttttgcattggctgcatttttacaactttatttataaaggtagaaatagcaacaatctttacatatttgtagtgtaacttgcttaaacattactcttatgttggatattcttttattttctattaaaatatcactactataaatatatattcatatatatacacatagaaaataattttttactcaatttagattatattaataggaagcatgatttcaaagttaaagtgtaacatattttttatggttcttgatacatatagctaaattgcttttggaaatgattgtacatatttagaatgcaattagcaatgtataaaactgccagtttcactgcaccaccatcaaaacatgatttcttcaataaactatttaatagatttaatacttaataataccttcctgggtttttttggttttcttttgttttaaattaatgccttggcagaatagggtcaatgctgctgtggaaatatagtcatggagcaagaaattcaagacttttttttttttttttttggtgtagtttagcaggaaaggtgcagagagtgtgagaaagaagccatttcatctgggtgcgtggtgaagtatagaagggttcctatttaaaaatctagggtttttctcctactttttaaaaatttggcctattctcctatttccttatgactgtgtaaagaaaaaatccccaccacctgccactttaataagaaatgtactattttgttccaaagggcacttgttttgcatgtgtcagctgaagacagaggctcatgtgaagcttaatctggacggaactgtgcagtccctaccaccatcacagctctagagccatggaaagtccaacaactaatttctgggcacagtttactgaggaggaaacttttgattctatagtctgtctttggggactccagtagatttttttgaagtatgtttaataatgtctggtacgtggaagtcctgagacttcaaacagcctcagaccatttggctcttggtcagttagagcaggtgattcaactgcttctgcaataggtagcaggcaggacacaaaaggagctagccaaggacttattgcagttgagacaggaaggagagactgcaacagcctgctaccatgaaaggtgtatgtgtgtgtgtgtgtctgcatgtgagttcattggccggggtagtaatggtgtttaggactacatttgttatctaggtaatgtaggggcaagggaaatgagatagccctgtttttgttttcagtgttttccttcaaggcctgtttttctctctgggttgagaactaggaccattttcctggttactgtttctactacttagggaagtgtagggagaacataccttcctgtgtgtgaattagagcaaaggccaagtctctatgtgtgcatgtgcctgcacatgccagtgttctgcatttgaaataggtctggtgggccattaaaagggacacgggcttgagcgtttttggtcttaaaggtaggggtgacttaagcagttatagcctttgtagaaagagtctatagaaccagacacatcgaaggtctaggagaagaaaaaatggttctcctgggagaacaacattcctgggagatagtttacctactaatgaagatatggctgatcaggcaataagaattgaaggaaacaacccttgatggtgaaattggaaaccacaaggaagagaaaatgattgaagtcatggggatggtgtacttgtcacggaaaagcatgttgaagatgggaagaaatagaaacaaacttagatgtggagacctgagtggaaggagcaagtagagcagaaactcacaaatgtaaggtcagttttacatttgtcactttagaaaatcagaattaaatttatgttttaggaattttaggataaaataaataggcattcttctatcttcttaagagtattgtgagcattatagtaattcagtttccaggtatatgcaccaaagaattgaaagcagggatttgaacagatatttgcacacccatgttcatagcagcattattcacaatagccaaaaggtggaagcaacccaagtgtccactgatagatgaatggataaacaaagtgtggtacatggcatataacccagtcttaaaagagaggaaattctgatacatgctaaaacgtggatgaaccctgaggacattatactgagtgaaataagcaagtcacagaatgataaatactgtatgattccatgtaatcataattatattccatgtaataaatactgtataattccatgcactctaagtaatcaaaattcatagagatagaaaatacaatggtggttgccaaggtccaggggaagggggaataggaaggtagtagtgtttaatagatacagagtctcaggaagattaaaaagttctagagatggaagatggtgatggctgcacagtaatatgaatgtacttaatgccactaaactgtatacttaaaaatcgttaagatggcaaattttttgttatgtgtattttaccacaatgaaaacaagtggagggctcaaaaatatatacatttcataaaattacagtaatctgacaaccacagttttcggaccactagagttcattaatagtgatttaaatttttatagcaattgaaaaaatctgagatctttcacaaacacaagatttagtttagtcctttatagttgttcctaaagttgtctattaaaattacttattaaactccataaacacacaaaatacaaatgtctgggccctgccccagacctattgaatcatactctccagggatagatgccaaacattcacatcttaacaggtgcttcagaggacccttatgcagcaaaaaaatacaagtgcccccccacacccaaattactcttccctctttagacctgggggtaggcctcttggggatcatgcagagaaaagatcttttaaattttatcctttcaacaaatgtatgagaggctagtctggggaaataatacttcttaatcaccttgataatttataaaaatgcataagcattttataaaagggaataagggaggaccagtaataaaagatgtaattattgccatctttggtgagtggaagtttagtgtcaggtatttgatttagaaaaataaagaaatgtgacagtcctaccacttcaagcattgtagaagtatatatatgtctgcgtgtgtgtgtgtgaaatatatattatatatattactattttttccattgcctttcattaaaaaaatttttattttactttaagttctgggatacatgtgcagaatgtgcaggtttattgcataggtatatgtgtgccatggtggtttgctgcacctgtcaacccgtcatctaggttttaagcctcacatgcatcaggtatttgtcctgatgctcttcctctccacctctcccatgacaggccccagtgtttgttgctcccctccctgtgtccatgtgttctcactgttcaactcccacttatgagtgagaacacgtggtgtttgggtttctgttcccgtgttagtttgctgaggatgatggcttccagctttacccatgtccctgcaaaggacatgatctcattcctttttatgactgcatagcattccatggtgtatatgtgccactttttctttatccagtctatcactgatgggtatttgggttggttccatgtctttgctattgtaaatagtgctgcaataaacatacgtgtgcatgtatctttatagtagaatgatttatattcctttgggtatatacccagtaatgggatggctgggtcaaatggtatttctggttctagatccttgaggaatcacactgacttccacaatggttgatctaattcacattcccaccaacagtgtaaaagcgttcctatttttccacagccttgccatcatctgttgtttcttgacattttaataattgccattctgactgatgtgagatggtatctcactgtggttttgatttgcatttctctaaccatcagtgatgttgacctttttttcatatgtttgttggctgcataaatgccttcttttgcgaagtgtctgttcatatcctttgcccactttttgatggggtttttttttttcttgtaaatttgtttaagttccttgtagattctggatattagacctttgtcagatgggtagattgcaaatattttctcccattctgtaggttgcctgctcactctgatgatagtttcttttgctctgcaggagctctttagtttaattagatctcatttgtcaattttagcttttgttggaattgcttttggctttgttgtgatgaaatctttacccatgtctatgtcctgaatagtattgcctaggttttcatctagggtttttatgattttggattttacatttaagtcttcaatccatcttgagttaatttttgtataatgtatgaggaaggggagtccagtttcagttttctgcatatggctagccagttttcccagcaccatttatgaaatagggaatgctttccccattgcttgtttttgtcaggtttgttgaagatcagttggctgtagatgtgtagtgctatttctgaggtctctgttctgtttcattggtctatatgtttgttttggtactagtaacatgctgttttggttactgtagccttgtagtatagtttgaagtcaggtagtgtgatgcctccagctttgttctttctgcttaggattgtcttgactatatgggctctgttttggttccatatgaaatttaaagtagttttttctaattctctgaacaatgtcaatgatagtttaacaagaatagcattgaatgtataaatcactttgggcagtatggccattttcatgatatttattcttcctatccatgaagatagattttttttccatttgtttgtgtcctctcttatttcgttgagcagtggtttgtagttctccttgaaaaggtccttcactccccttgttaggagtattcctaggaattttattctctttgtagcaattgttaacgggagttcattcatgatttggctctctccttgtctattgttggtgtatagaaatgcttgtcatttttgcacattgattttgtatcctgagactttgctgaagttgcttatcagcttaaggagttttggggctgaaatgatgaggttttctaaatatagaatcatatcatctgcaaacagagacaatttgatttcctgtcttcctatttgaatacactttatttctttctcttgcctgatttccctggccagaacttccaatactatgttgaatagcagtggtgagagagggtatccttgccttgtgccggttttcaaagggaatggttccagcttttgcccatttgatatgatattggctgtggtttgtcataaatagttcttattattttgagatatattccatcaatacctagtttattgagagtttttaacatgaagggatgttgaattttattgaaggccatttctgcgtctattgagataatcgtggagtttttgtcattagttctgtttatatgatggattaggtttattgattggtgtatttgaaccagccttgcatcccagggatgaagctgacttaatcgtggtggataagctttttgatgtgctgctggattcagtttttcattattttattgaggatttttacattgatgttcatcagggatattggcgtgaagtttctttttttgttgtgtctctgccaggttttggtatcaggatgatgccagcctcataaaatgggttagggatgagtcccttcttttcaattgttaatggtttcagtagaaatggtaccatctcctctttttacctttggtagaattcagctgtgaatctgtctgttcctgggcttttctggttggtaggctattaattactgcctcaatttcagaacttgttattggcctattaagggattcaacttcttcctggttcagtcttgggagggtgtatgtgtccaggaatttatccatttcttctagatttcctagtttatttgtgtagaggtgtttatagtattctctgatggtaatttgtatttatgtggggtcagtggtgatatcccctttatcattttttattgtgtctatttgattcttctctttcttcttctttgttagtctagctagtggtctatctattttgttaattttttcaaaaagccactcttggattcattggtttttttgaagggtttttgtttgtttgtttgtttctatctccttcagttctgctctgctcttagttatttcttgtcttctgccagcttttggatttgtttgctcttgcttctctaattctttcaattgtgatgttaggatgtcagtttgagatctttctagctttctgatatggtcatttagtgctataaatttctctcttaacccagctttagctgtgtcccagagattctggcacgttttctctttattcttattggtttcaaagaattttctgatttctgccttaatttcattatttacccacgagtcattcaggagcaggttgttcaatttccatgtagttgtgtcgttttgagtgaggttcttaacaggactgtttgagtgaggtcctctcacttttgtgatttcagtatttttgcatttgctggggagtgttttccttccaattacgcggtcaattttagaataagtgccatgtggcactgagaagaatgtatattctgttgatttggggtggagagttctgtagatatctctcaggtccacttgatgcagagctgagatcaagtcctgaatatccttgttagttttctgtcccgttgatttgtctaatattgacggtggggtgttaaagtctcccactcttattgtatgggagtctaagtctctttgtaggtctctgagaatttattttatggatctgggtgctcctgtattgggtgcatatgtatttaggatggttagctcttcctgttgcattgatcccttgaccgttatgtaatgcccttctttgtcttttttgatctttgttggtttaaagactgttttatcagagactagaattgcaacctctgcttttttttttgcttttcatttacttggtaaattttcctccatctgtttattttgagcctaggtatgtctttgcatgtgagatgggtttcttgaatacagcacactaatgggtcttgaactctttatccagtttaccagtctgagtctttcaaatgggccatttagcccatttatatttaaggttaatattgttatgtgtaaatttgatcctgttctcatgatgctagctcgttattctgcacactagttgctgtgatttcttcatagtgtcattgggctttatattttagtgtgtttttttgcaatggctggtacaagtttctcctttctgtgtttagtgcttctttcaggagctcttgcaaggcaggcctggtggtgacgaaatctctcagcatttgcttgtctgaaaagaattttatttctcctttgcttctgaaacttggtttggctggataggaaattctgagttgaaaattcttttatttaagaatgttgaatattggccctcaatctgttttggcttctagggtttctgctgagagatccgtgctagtgttatgggcttccctttgtaggtgacctggcctttctctctggctgcccttaacatattttccttcattttgactttggagaatctgatgactatgtgtcttggggttgatcttctcatggagtatcttagtggtattctgtttttcctgaaattgattgttggcctgtcttgctaggttgcagaagttctcctggataatattctgaagtgtgttttccaacttggttccattctccctgcctctttcaggtactacaatcaatcacaggttcagtctttttacatagtcccatgtttcttagagattttgtttattccttttcattcttttttctctaatcttgtctgtctgtcttatttcaacaaatggtcttcaatctctgatattctttcttccacttgattgatttggctattgatacttttgtatgtttcataaagttctcatgctgtgtttttcagctctatcaggtcatttatgttcctctctaaactggttattctagttagcagctcctgcaaccttttatcaaggttcttagcttctttctttggattaaaacatgctcctttacctcagtgaagtttgttgttagccaccttctgaagcctacttctgtcaattcatccatctcatcctccatgcagttctgcacccttgctggagaggtattgcaatcatttggaggagaagaggcgctctggcctttttaggttttcagtttttttttgttgttgattctttttttttttttttttttttaagacaaaatctctcactcagttgcccaggctagagtgcagtggcatgatcttggttcactgcaacctctgccttccaggttcaagtgattgtcctgcctctgcctcctgagtagctggaattacagacacatgctatcatgcccggctaattgttttgtatttttagtagagacggggttttgccatgttggccaggctggtctcggactcctgacctcaggtgatccacccacctcagcctaccaaagtgctgggattataggcgtgagccaccttgcctggcctcactgattctttctcatcttcatgagtttgtctagtttcagtctttgaggctgctgacccttggatgaggtttttgtgggaacattttttttggttgatgctgttgttttgctttctgtttgtttgtttttcttccaatagtcaggtccctcttctgtagggctgctgtggcttcctggggttcatttcaggccctattcatctggttcacttccatgcctggagatgtcacttgaggaggctggaggacagcaaagatgggtgcctgctccttcctctgggatctctgacctcaaagggcactgacctgattccagtaggaatgctcctgtacagggtgtctgacaacccttgttggagggtctcactcagttaggtggtatggaatgcaggacccaattaatgaagcactttggctgtcccttggtagggggctggtgtgctgccatgtgggggaaacccactcatctgggcttcctgtattcctcagaactagcaggaggaaacactaagtctgctggttcatggagactatggccacccctcctgctaggggcttaggcccagggagattacggttctgtccctgagcccctggctggagttgttggagttcctgcagtgaggccccacccagtgaggagggatgggtcagggtcagacctgaagaggcactctggctgtagtctgccacagccggtgtgttgggctgtgggggatacctcttgggaccaagccatccagcctccctggctccagcaggggaaaagcatgacctggagctatggagatggctgctgcccttcccttgccctgggggcttagtgtgttaggcagctagcagtcccagtgttggctgccatccctccctcaaggagctcaaatggcttagacagcgggaagccgcagctgtggtgctggccgccccttcccccaataactctgcaggcttaggcagattctagctgagtggctgttgaaaatctatgtggcttcatggttgggaccctagacctgggtggcatgggctcatgagtgggatcttccattgcacagttccatgggaaaagcatggtttcccaggctgagtagcatgcttgctcactgccttcttggctggtgggtgggggctcccctgacccttgtgggtctcaggtaggccgcagaaccacactggtcttcctttctcttggtgggtcatgccagccgcctagtcagtgctgatgacagaacctggatacctcggttgccagcacaggatttgcaggctgttttgtttctttttgatgcaagcctccaattgtggctgcttctagtcatccatcttgggcctgccccccagttgcctttccagacctgtgtagggcagagcctttgggtttatgtatagaaagaatgcaaatgcaaaacattaaatttcaagccagtagataatggttctcaatccttttaactggatgccccagcagatcacagaacagcaacatgagttctagaacaaatgcaaaaggtgctctggtagaggacttcctgccagaacaagttttcaatgacaaatatgacctgttttggataagacgtattctagacttttatttactctgcttttaagtattatatatatttagcccttaattttttgttcctgtcaaaccttttattttccacgaagaagtattgtcaaccaaccattctgccagccccagaacttttcacatgcaactttttctccccatggttggcaagggatcactgtaattatttcaggcatgaaaataagcatttatacacttacttttcattaccttaagaaaaactgaacaagtaactggaagcattttaataagtgtggcagggcaaggtattaataatttacaggagcaatatccctgtacacaatcccttcctcgccccattggagtagtcttatcagaaaaaagaaaaaataataagagctgattattcccatggaagattgtcctgagggcatttgtaaaggtaaaactttgaagctgcagtcttggcacctgtagttgagaagatgtctcactgaagggacctgggacagacccatctctgattctctatgggctgctatgttaccagttctcaaagatgggggaagagaattgtgctcaggctgagttctgcactcaaatgaggaacggtaagatggcaaccacaatggaataagaacctgccctcccccaccctttttctctggaccttgtcagccctaggatccttgtaaagtccctcccttgaagggagtggaagtaagtatgtaccaatgactgatattgatcagctgctttcctacctaggtgagcaagggctcagattgcagagtaatttgatatagaaaactaaattgaacaattctagcaccttgtgttatgcaggaacttattcatgttatatatgatgatggatattgcctaccattttttaataaaattgatttccacaagacctgtttttttggggggttgggtaggggggcttgatttttcctacaggaagatgagtctttccctggatcaagtgtgggagaaagaggggaagaccgtggaactggttctgagcaaaagtgtaagttacactattatggaaaagatctatgcacattttgaaactcgaaggttttccagaattattgagtttatacaaattctgtttttaaggctgaattagcagctatcagaatccattacaatttttttgttttctttttctttttctttttttctataatagaataggcttgctgttgaggaaatgtgtgaaaataccagtgggggagcagatttttctaactgattaaaatatgtggagctgctgcaatgatttcctctgtgtttcctttggctacagataataccacaaagctaactcagtgacgcacatggccagctgataacagctgacacatgtgaatcgaaagccaagtgtgtattatcagaaagtgagttaaaaacccataaaactccccactgtctgacttgaaaacattcctcttgaaattttaatgacatggtaggtaatatttttaattctgcgtgctaaaacacttccagtgaaatctgagagtaaaagcatgtccctttaatcaatatgagctagatatacaacctaagtattaatatattcctgcaatagcaggattcctgagaattgcgtaaaattggtatcattcattaggatgtacaactaaatattggacgatcttgatttgccttttaaaatttaattttaatattgtaatcaaacattgacaaagttaaaaaactccaacagtaccatagctttaaaaagaaaaccagcagtcctctgctaaaacccttcccatcacagattcctgttccctggagatactttcaattattgtagtcgttatgtttattgtttactgtaatattttaaaataatcttatactattatttcttcaattttaattcataaaaattatctaatgacttcatattactgaagatatgaattttggtctcttctactgcccacttctctgttcacactttccttttcctatccttccaatgcgacttttgatgaaatcagtttggtacatttttcttggttaaattccctgcttattatgattatttaaacataattcaccactgagccatagtgaattatgatcctatttctttcttatacagcttttcatttttcatactaattgctttttgtcaagtttagtcttctatgcagccatcattaatttattcccaaacttcccacaggacttcagatcttctctcatctctcaatatgttaaaatacacctaaaagttaaataaaaaaataagctaataggtactaggcttaatacctgtgtgacaaaataatctgcacaagaaacccctatgacacaagtttagctacataacaaatctgcacatgtacccctgaacttagaataaaagttaactaaaaaaaaaaagtccaccaaatgtgggccatgaagatgcgcagcccagatctccttacagagtctgctataggacacatggggattgccttcagttgctgctcctacagctgcttagaacatgcttcccctaggttgttctcggccaatgactgaacatggctggggtattagggcctagtcctgtcctagtaccaatgaacaacttttgtgtgggactcccctctccactggcctggctacaactttctcagaactgtgctgtggtctggggcttttctacccaatcctcccttccctctcctttcaaaaggtcatatctgcaaacagttatccctgcctaatcctggtctggccccctttatccttcacagacattccccccagtaaatttcttgcacatccaatctcatcttggcacctgcttctcaaaacggggccctgagaggagtctgagaaagcaggctctaagatggacatgtggattggcttactctttgccctgatggtggtaaggaggaccccatcctgagagtaatatgaggtcaatggaacctggtacagttggaggctcaattacttaaatctcacttgtggtgatttgggaaaacagccagagggctgatgattgctaagttatattgatgtcctacaaaggataatgaaaaactgagagtgattaacaaatagtgaaaggctaaatgtaagtgccagagggactgttggtagttcacaaataggtccttatcttccacagtagaagaacatacacagctgagaagcagacatgggattttatagttaaagtcacaaagcctcagaaacatttaaatgctcagctgaggcaggttctggaaccctgacacatgcgatagagacatctaggagaatgccttgagattttttttttttgagacggagtcttgctctgtcacccaggctgtagtgcagtggtgcgatctcggctcactgcaagctcctcctcctgggttcacgccattctcctgcctcagcctccctagtagctgggactacaggcacctgtcaccatgcttggctaattttttgtatttttagtagagatggggtttcaccatgttaaccaggatggtctcgatctcttgacctcatgatccgcctgcctcggcctcccaaagtgctgggattacaggcgtgagccaccgcgcctggccaagggtcttgacactacagatcccctgaaccctcagagcttacggagacatctcctttttccatagcaagggctactgcttcctctaattggaagatgctggagaggcctcttcccaatcaggcaagcgccgcctcaggaatgcctccattcctgagggtcaaatcccagtgcagcttcatggggaatgtgctgggcctggtaagaaaggaaagaaaccatgtactaaaggaacagcaggaactagttagcatgaactagcagaagccaggggagtatattagtgattggattttgaggaggtgatatggtttggctctgcgtccccatcaaaatctcatcttgtagctcctataatttccacatgttgttggggggatccggtgggagactattgaatcatgggggtgggtctttcccatgctgttctcatgatagtgaatgggtctcacaagatctgatggtttgaaaaacaggagtttctctgcacaagctctctttgcctgccaccatccatgtaagatgtgacttgcttcttcttgccttccaccatgattgtgaggcctttccagccacatggaactgtgagttcaagtaaacctctttcttttgtaaattgcccagtctcgggcatgtctatatcagtagcatgcaaatgaactaatacaaaaggcttgatcaaggggaccgagaaatgaaattgtataagcaaaatttattgacttgggggtactttcttgggacataggatcctggcaaggaccccaagtgatggaacaaacttgttgccagcatggacctttgaaacctggaaaaagcaatggtctgaatgaagtggaaatgccagacatcagaagaattacaaaggctaagggaatcaggcaaagagtgaagactttaaatcagatgttaatgcctaccagaaagcatacaccatggaagaggcactgaacaactaaattgacaaaataacttggtcatttggcattatccagtcttcatgattggtcactctggtactaatgggaaaggaataataacatagtggtcatcatggtggcagagatgaaagatatacatgggcccaacagtgggaactttcccacttaccaaggtcaatctacctactgctgcctctgaacatccagtttgtcattaaccaagatcaacactgagccctgatatggcattattgctctaggggaccaaataaccacttggtggcaaaccaaccaaattgggtctcttatctggtggatggaccagcagttcgtccactctgggacagatacctattctgggtatgatttcctgcccactgagattcagctaacactgttttctgggggcttaaagaatacttgactcataggcatggaatcctgtacagcatagcatcagacaggggactcacttcacagtgatgtaggtgtgggagtagggctatgacatgggattcactgatcctatcacctactgcatcatttagaagcagctgctccatagagggttgggatgactttctaaaggcacagtgagagtcctagttaggaggcaatactctgtgaggatggtgtatcattattcaggatgtagcatatgcattagactggagaacttcatattgtattgtgaccccaggaggacgaatacatggatctgggtaccaaggaggtggaaccagaaatagctccatcccagtgatctgctgggggcctttgtactttccatcttgcaactttgggctctgcatgattgaaagtctgtactagtttgggttctctagagaaacagaaccaataggatacacacacacacacacacacacacacacacacacacacacacacaccccttccattcctgagggccaaatcccagtacagcttcatggggaatgtgctgggcctggtaagatgtgtgtgtgtatgtgtatttttatatataatatatgtcctatatatttagaagtacatatatacttcttatatatttatatatactatttatttacttatatatataatcttatgttctatctatttagaagtatgtatatgtcctatatatttagaagtatatatttttatatacaatatatagtcctatatatttacactttatatatacacattatattaaatatatatacattatatggtaccttcatattaaatacataaagtatatgatatacttcctaatatataggacatatattaagaatatatgtttttatatctctctatatatttatatgtatagagacatatcctatatgtatattcttagtatatatgtactatataaaggacatatacaaatatatatggtttttttaataagttttttttattttttagttgtattttaacatattgagagatgagagaagatctgaagtcctgtgggaagtttgggaataaattaatgatggctgcatagaagactaaacctgacaaacaacaattagtatgaaaaatgaaaatatacaaatgtatatgtccttaatctatataggacatatatattaagaatatatctctgtatatctcttatctttctatctatggagggattgatttattataagaaattggcttacaaaattatggaagctgagaagtcccatgacctgtagtcagtaagctgaagacccaggtgatctggtattaacggtatagtttcagtccaagtctgaaggcctgagaaccaggagagctggtggtgcaagttccagtctgaatgccagcaaatactgatgttgcagtctaaaaataggcagagggagtgaattctccctcacactgccttgtattctacttaggccaccaacagattgggtgaggcccacccacactggggagggcaatctgctttactcagtctgctggttcaaatgttaacctcatccagaaagaccctcgcagacacacccagaataatgtttaaccatatatctgggcaccctgtggaccagtcaggctgatacataaaattaaccatcacaaagtctatgtccccaaagggagtcattcttgcaaagagacacagtaaaggtctccttgaattataagctacagctactgccagaccacttttaatttcctgtgtccaaggaccagaaattggggacaggaggcaccatcttggcaggggcagttggcaagagaaggtaagactgctttcccacaatgggagcaggaaggaattcatgtggaaccaggtggtcctctgggtaccgcgctgcccagtgtaactgtgagtgggcacatgcagcaatcctaacctgaaaagtctctgattagaaagagctcaggctcctcaagagcaaagttttgggtgaaaccaccaggtcagcctgaagactttctgaggtgacagctgaagattagtggaattctgagtaaataacgatgaaaggagaggacgagtgcccatggcatccctaaaaccacctgcagtgacgcaaccatcatgcatcccaccagctttcctcttctcagattcctttcaagaagagaggcccatgacactttggaggaactgctcctcaaatgtgcctgaaatgaatctttttttttttcccttggcttcagcatcccaagtagctgggattacaggcgtccaccaccatgcctggctaatttttgtatttttagtagagacggggtttcaccatgttggctaggctggtctcgagctcctgacctcaggtgatccacccgcctcggcctcccagagtgccgggattacagacatgagccaccgagtgcagctgagaagcgaatctttcaagaagtgtggctataatgacaacaagagagaagggagaaaccatgtcaagaaacagtttatttaatatgagggagtgtattttaaagaacgcaaagtgggagcgacttattgaagatataagagagagggaagagataagtgattgacaataaattgtccctgagaagataggaagaaataggaccttggcagaggagtggtcaggagaaaagagaaagatgctctactgtgatcagagaaaagagtcaaaggagaggtatgagcctacatttatagttttggatgcagatggtgagggcattcctatgtgatgggttctttttctatttgaagtttgaggcaactttgcttagactgaatggcacttggtagcatgagagtggtgtgaaaagagaggtgaggtgattgtgggaatagtaggtgcaattgagatatttgttcaaaaacaagtggatctttaaaatcattttttgagcactaacaatgtcaggcacactactgagctcttttccgcattatttctaatatttaaacctatcatacttactctgagaattaatgaatattgcctttaatttattggaaaagaatgttttcttacttgtccaattcattcctttacttgtttaacatatatttactgagcttcaattatatggcaagcactgttctcagcatagtaagtaagtgtatcagtaatgcaaaccaagggctgcctgatttcaaaatccagtttccttatagtatgtcaataaaaatgatccaacaatacaaaatattgactctgtgagccctctaccgggttcacctattctaatgagacagggaactactactttatacaacaaagacagattgattatttatagttgtttaaattatttcaagtatattttcaatgataagtttggaagttgaattccaatataatttctttatggtaattaagaagatgaattagtatcttattaaaatgtattttccttacatattcaaaagcaacatcttgaatatttgaaaacgcttatggtaaaattatgactaattcatgatttagtgcatcgcacttcagctgaaatttacattggcatttactttgaagaaataatttgataaccaatgtaataatttgcacaacatttaaaaaaggtttgtgagtttgaggagtggttgtggttgcatttaactcatcctttaaaaccagctttttttaattggtcagcatatttctttgttagtaactccagtcatttattgaagcacactcaaatgatatttacttgcacaaacatattagggttataatataccttttctgtttttaaatttctatttgttgcaattgtagacagataaacgttattggccccctgtgcacatggggcttttgtgggaaaagtgcaatgctataatacattaaaagccataagcttttacattaaaaagcagtgatgatgggatgagggtaagtgccatcccatggtgttattgctatagcatcagctgtggcactattttcatgaacagacttagagttgagtacctctcaaagcaatttttatgtttgaacaaatacagtgatggatcagcagagtgagttactcatcaagaacttggcaagaaggatgagttacgctgagcaaaaatgctgctgagtttaatgactctttgggaacatgtaggcacttaagtctctggggtctaaatctggttaattcacaagtgtgaaattgtcagcctacttaaaagaggcagaaattatgcaatgcttttagaaagcaattttaatgtaagaggagcactggaagccagacagggcatagtagtattatattaatgacttttgttttgtcatggtagaacagttaattgattccatgaggaagatggaacaaaagagactttctagaaatttcattctccttctaggagagaagagataatcagggaaggatttctcattttaaatctctgaattagttcttattcctgattcaggaaaggttttctctaataagtatgcactcagagtttgaagaaaaatgtgatgtgactaaagagaaaaaacaataatatgaaatgtctttattaccttaaataagtaaaattagattcaacatacccatttgttagatactgggatttttgaagggatgatttaccatgtataacatgttctcatttctcaatgtatttcacttccttggccttcaaatattgcacttgttactattcttacactttaccagtgaaattaaatcaaggcaaataagagtttttttaacatgtttttaaaactttttagagataaatgtgttccttccactcctatcgaaaatggagtaacaaggactttctaccagaagcaactagaaaaccaagatatatacgtctggtttttaaaccttgagcctaagatatcataggcctgtgattgcttcaagaaaaaaaaaaaagaaagtgcgctctaaaattgcatttttttttttttgcatagcaggtagtacagggaggatgcattcagagaccagagattctgctaaattgaagaaaaagaggaactaacccacaaaggccaaatttgttagaatttgcaagcagtctaccagtggggaaggaacagcacaaagacagagctctagaaatctgcagagaggttcccacaagtctttggatgaatactgatctctataatgcatgagaagaaactatctgagattggagtgggtggaacaccacaaatagagtgaggagaacagtttcagagctcaaactggctagaaatagttcatgttttcaccattaaagtggaaataatttgtcatacaaagagtattgggtagaatgctcagaaaactgtcacctttgttgtggggataaactggctctatgctaaaggctgctctcaacacacacaaagcttaaggacaagcatcagaatgatttaactggttccaagcaacttaactgcatgccaaagcaaagtctaatgctattttaaggaatacaacaaaactcagtaaagaacaacgtaaaaatcacaatgaatggcatccaacagaaaactaccaggcatacaaaaaaaaaaaagaatatgattctagtaagataaaaaacagaaacaaaatctacaaaatagacccagaaatgaaaaaaataataaaaccagcagataaggatgttaaaatagtgattataaatatgctcgatatgtttaataaggtaggtaacaaggagataaataacctaaatggaatttctaaagctgaaaaacacagtatctgaaagggaaaatgcaattgaatggggtcaacagctgattaaacaatgtagaagaaaagatcagtgaactttaggatgtagaaactatccaaaatgaagcctaaagaaaaaaaaatggttaagacaaatggacgtaacatcagtgacctgtgggacaatatcaaacagtctaacatgttattacatctaattggagataaagaggtgggagacataaaaatattcaacaaaaaatggccaaatatgattccaatttgattataaacagaaattttgagaagaagccagagggggaaaaaatcttatcatatacggaagaacaaagaattgtcacagatttcttgtcaggaactgtgcaaactaaaagacaaatttaaagttctgaaagaaaaaaacttgaattttgtactgttgaatatatgtttcaaacaaatgcaaaaggaagactttttacacacacacacacatacacacacacacacgctctcttgagaaaatttgtcaaaagtacacctgtacaagaaatgttaaaggaagttctttagggcagaaaattcataactgtttttttttttattcattatgcctttttataaatgttgacatttttctttattgtaatgtatttttaccatgaaatttactttacctgaaatcaatattgctatttttatttattttacctgatttttgtcttaattagctactgttttttcttcatttgtaatatttataatatatttatttaacataccttttctaaggtggaatagtttgaatgctactttttgaattattctgtgtttgtctctttttgaattgaatttaagcaacttgaatttagttataacaaatatatttagtctgtctcctgtcattttgttttatattgtctaaggcttcattttctatgccaatactttcgtattctaaattttagggactattagtttatgtatgggtatgtgtgttgctgttgcttatatggagcatattttgtttgcttttataaattgcctactgcattagaaggcatctgtaaggcttaggtccaattctattagtgatcactttcacattcaaaactatgcttgaatctttttttaaatttccctatttctgaatttcaagaatgaaaaaaaattgctacctgtaatattacatgaataatttgatgtatttcaccattcttctagaaaatatactcatttttgctatttcattatgttattaactttttaggagactatcaaattgtttgcaacgtgatgatgtcatttcatagtcccaccaactatataggaaagatgtacttgctattgtagccttaaaaatttttagcctttagaagttttatagttttagtatttatattacggtctgtaatccatcattttgagttaattttttaaaaggtgcaaggtaaagattaaacttcatttttaccgtatggatatccagttggtctagatcacttgtggaaaagactatttttaaccctgttgaattatcttgacactttgattatcttgaaaatcaattgacaatatatgtgtgggtctattctgaattctcagtttggttccatggatctatgtatgtattcttatgttgataccatattctcctgattactgtatctttatagtaagtcttgagattaacaagtataaatcttccacttttccctcagctatgctgaatcttttgcatttctacataagttttagaatcagcttgaaaatttatgtcaaaaaagcctgtgagaatattgattaggattgcattgaatctacagaccaatttggatataattgaccttttgacaatttcagttttctaattcataaacatgtatgccttatctttttgtgtatatcatttaatttttctcaaggatatttgtataggtgttgcacaaaatttgttaaatttcttccctgtctcaaagtagaaaatagaaaacaatcacagagatgccattataaaatatatagatatagcaatcctctaaaattcccatttaactctgtagtttgaccggaatgaaagacggctatcttggagaatgatgttagattaatcaagtagtcactctaataatagcaactgttccaactaccatctccatattgaaatcctacaaatgtttcctctttaaaaaaaaaattcaaaacagaagaaccagcagcatgtctttcactaactgattcagttagctcctggggcagtgatcatctccctattttataggacatcatactcatccgttacattgaagataccatatagattcttggatagaataagaaagagagtgctaggtgccttagagtacatgtactgatgaaaatacaggagcctgacacttaattaaattttttggaatttaggagccttggtcaagaaagatagatatctttattagagtaactaatttttttttaaagagatgaagtctcactttatcaccaaggctgaagtgtagtgggcacaatcatagctcactgcagcctagaactcctgggctcaagtgattctgccacctcagcctcctgagtagctcggactacagacacatgccaccatgctcagctaattaaaattttttattttttgttttttatttatttttatttttatttatttttattttttatttttttttagagattggatttcaactatgttgctcaggctggtctcaaacttctggccccaatagatcctcccacttaggcctcccaaagtgttgggattacaggtgtgagctaccatgctctacagcaatgatttgctgaaccttgtccatccttcaatgtttagggtatcttttagattttgtaggcaacttatcccatgtataggtgtgtgctgcctaatttattaactgaatgacctaaaaagcttccccattaaggcccagaacaagggagggctttcctgatggcccaggctgcagtgtaaacagctaaactgtttggctcccatgttgcttaaagtgtctatggaagatacgaatgctgtggcaagtcctataagaggattgcagaagagactggtatctttgatttgagatgcagctggaatggaaatttgtctcacttcactttctgcctcatgtttcctccatcaccaaggaagctggtaataacttggttggtctgaacccatgcacagctcagaagtgtgagtgagttaatacccccaaggaaaacttttgactaattgggggaagaaagcagatagataaatgcttctcctgtttccctccttctgatagaaaattcagggaggtatctggaaacttctcaggagccctcaacagaacagtgcattaatatactacagccaaataccactaagaacacatctgtggcagaacaagttcggctcaaggttcattgcaacaagggagaactcccctcatagggatctttgggacatttctgtaagatggtgttaaaaggacgtataggatttttagctatgccaggtattttgaggagagttcaagaatgcagggctttgttatggattagatgctgtcaggaagtgaggataattctgactgggtgtcttaaatctttacaaggtgagaagactaaagtgagggtaaatctaattgataaagaatcatattagcaaggttagggagacgcttggtcatttgtatggtttggataatgttgtttttaatctgtgttcagatgtgattacgaagtggtatttttgctctaattcattacagttgtggtgtggccttgttgatgttgatgttctaggaaaattgttcacatccaacaggagaatgttgagacctagctgtgaatgccaggccagctcttagcaaaaccaaagtctagctggtagttccaggctattcttatcagttaagagctatttttctctctctcaagaaccactggttttctggaaggaatagcttcaagaataccctcttataatggcttttcatccttcctgttgcattctttctggcctctcactctgtctcagtctataccttcagccttctgtaggcatggtaactcaagttgagatactctttcaggaacacaaacaatattctaaatagtattccccttttgaaaaacagctgcccatcatgaactgtgctatatgatccatctggccataaggtcgggacgtgctaactatgctccatcattaagtggacgtagatattctcaacagggctcaattgttcctgaaggcaaaagtacctttcctgaataggacattcacatgtccagtgtgccttcactttattacccttcagtttgctcctgtggcctgtggacattcccaatgactagttggctgaggaggtatggctgtgagtctgctttacagatggctctgcatcatatggcatcatctgctataactggccaaaataattatgaaaaagttcagctccattcaggattggtttagaaaggacattcctgaggaggcagaatttgaaacagaaaaactcattttcccaattgtatcttgagctaaggatataaggatgggacaaggatggggaaaagttcagagctacttccttggcagcagttttctgtggcagccatgtcagaggacagtatcatgttgacatcagcagtggcatcaatcagtctcatcctgggttatggtgatggaggaccaggtacctacatgctccacatctttcccgatgccttggacttacctaaacctctgagatgaagctaaaatcctggaaaaaaaggaagtatgtaggaaaaccttgatttcactgaggaaaaaattagaataaaccacattcaccatatattgactaatattatgtttttaccaccagagaggcttgagacaaaaaataagttcagtgatcaagaaaacaaagaaaatatccactctcaaatttgtagcctgataattcagacctgtagttagaagtattgacagtggctttctagatagagacactaagagagagactaggaaacttaggttacttaagttttcttatttgtactatttttcatacatgtaacaaaattttttacaacaaatatgtattacctctataatcagaaaactataagcattgctttagaggaatatcatcaaggcaaaaacactactgaaagtcaatgatgagtatctgtgactagtattactatggttattattattacatttaacctaatagaaatggtactatacatttactattataaaccttatcctaataggagttatagttgattaaaacacttaaatttatcttgttgatattttcttagctaataatattatactataaaattaatacttctcggtcttttttgcaaactcttaaaatatgaaagacaaaattcttacctcttggtcatgtgagtcatcaatgactgtggaagctactcatgagctcatgcttatttataatcttgaatatgtgctcacacagattatataacattaagcaagaagcaattcactggcaatgcctaatattggggcagatagacacttatatgagttacacagaaaatattattactcacttttgtggacagtgggggcagagaggatttgttttcagctctaacttcagtcaggaaatgtctctactgttaacaagaaaagctctagacttactaaagttaacagcatttatttgagcaaagattgattcatgtattggtcagcactcagaaccagaagacgttcagagagctctgctctacaatgtgggcagtgagtattcatagacagaagaccatggaagcacagaaataccttaattggttacagctaggcttttgccttgtttggacatggtatgaataactggctgcttgtcatttgctgaagctctgctgcttgtgattggttgagatccggctattttaactcctaaattagattgccctacaggttgcagttctttaggtaggaacttcaagtatacagacagcctcaggctaatggccttctgcttatttaatgtagcagtaccaaaagaagtttcattctaccatatcccctttccattactgcagtgtatggaaagccacatttatcccacagagagaatagggctggaacagagggatctgaccacagtgagagggcagatcgcagagactgaataggagtacggtgctgagtgtgtagacaggattcagaaccttccacagcaatcagctgatacagactcaccgcctaatgattcagaaaatgagggatcaaagactagaatggagagagaaaaaatgaagtgtggcaagagcaacaaggggtagtgggatgcacagaaaggatccaaaggacatcagcactaatccctcagttgacaataatggctatctggaagccacctacccctgagaaattgtgaagtacatgtgtagatctcatgacacaaaagaatacttttagtatattgctgctataatcaatatgattaaaaggttaactacaaatttggagcatattggtcacaaaacagctgacatttctttctggatatgtaccaggtaatgctgagcagtttatatgccttgggtacatttaatttttccaacaacactatgaggtaggtactgttttcctcattgagaaaagtgcagaatgaccaagtggcttgcttaaggtccacagcaaatggttggcagggccagattcaggctgagatatctgacttcagagtctgagatgttaattactgcatagacttcttttccaaactgacggatctctgtgaggagcatcatcacatctctgttaggagcaactgttaatttattaaaacctactgtaggctgggtgcagtggctcacacctgtaatcccaacactttgggaggtcaagttgggtggatgatgaggtcaggagtttgagaccagcctggccaacatggcgaaaccccatctctactaaaaatacaaaaaattagctgggcgtggtggtgtgcacctgtaatcccagctacttgggaggctgaggcaggagaatagtttgaacctagggggtggaggttgcagtgagccgagtttgcaccactgcactccagcctgggtgacagagcgtgacactgtctcaaaaaaaaaaaaaaaaaaaacaccaaaaaaaccaccactgtatattccttagagtttagatagtatgactgagtggagaaaattttaagagtgtggattcagcatcttcaacagaatttttggttctgttttcttaatttatcctatagagtagtttcaggtactgatatttgtggatacttggaccaaatggaccatatcaaatattatgccagagattctgatccctaaactaagtagaataggcacttgatttataattgtgtcttaacaacatcgtttctctcttatcttgtgttactctttgtcatttattcctcacaggaagaaagaagtacctaaggccccaccattagaacctgactctgtgtttctaatgcttcaggccaaggaggaaaacactgtatttaatgcgcttgcagtatttctattcttgcaaaatacttactgttccaagcaagtgagttttcaaataaaataagaaaagcattttcctatttttgctgcttaccttattgctctataaccctctacaagtgtatctatttccaaatcgttttctctggggaggctacatttcacacttctacaacataaaatactaccacagagattcttaacagttgacatttgtagacctccttgattgaaaggttgtgcagtgaatacatttgttttggaatcaaataaatattatttaaatttggaaatagatacacttgtagagggttatagagcaataaggtaagcaccaaaaatacgagaatgcttttcttattctatctgaaaacccacttgcttggaacagtaagtattttgcaagaaaaaaattacctcaagcattttaagtacagtgttttcctccttggcctgaagcatcagaaccatagagtcagattctaatggtggggccttaggtacttctttctcaccgtgaggaataaatgacaaggagcaacacaagataaataaacctgttctaatctagagctaatatgatataatttacaaatgttctggttttaattttaaacaaattattctgcctgaccccatgtttttcattgcacactaatattgatatttgacacatcagattattagatattcataacatttgattcctttggctatcatggatcattcttttattcagtaaatatttatcgaaagccttaaatgagccaaactctattctgattctgggaatatagttggtaacaagacaaaaaagatcactgttcttgtggagtgaatattctcatgaggaaagagagacagtattcaaaatgtaagaggaatatgttagatagtgatgagtgctctgatgacaataaggcagagtctgatgatagggagggacttgggggctcctttggagtgagtaatccaagaagactggaatggcaagcagggaccactgctgtaaaatcagtgaaagagcatcccagatacagggaactgacagagctgcagtcaacaacctagaaccaggctgttcaaggcagagaatgcacgaatcacagattgctttatctagacaaaataatcaaaagatatcctggcattcccccttctgttggtgaggctccaagaccaacctcacaagacaaatggtaagactggtttgtttggtaagactggttttattaactactcataaagatggcagaagcaacagaattgactttcttgcatagtaaacaggagactagtctgtgagtgacctggagaagcttagtacggctgtggccagtttgatagttaataggttaattctgataattatcagctgagttgatagttaatcctatattgaaatcctggaggagaaagaatacaaaagagatgacatggaaaccagcttcttgttcgcacttgttactgagaaaacacactgcataacacacaggttaaacgctgtttgctgttcatggggctttaattggagggtcactcttctggatgtttgtatcacaagtgcattccagtggcactggcccaagctgttatttccaccttgtagctcatgtggttttgctatggtgctgatgtgcgtaaatgtggttgtttctgtggttttcttacaggtcctggagaattacatatcatgcaaaaggttataggtcagcttatctttgcagatatagaactaggtaaaactcccctaaaataccggtgcttagcaaagtaaccttgcaagtttactttgcccttcaatgatcaacaacaaaaaccaaccaactaaacaaacaaaaattagaactcattagcttaacgatccatcattcattaatactcttgagcttatggagaaaacaaccaatatataaaatattcttcaattgtacctgctgcttttatttcttttagaagtatttttttaagctgtacttttcctaaagcctgagaatattttgtgttatttttgatgccagaaaggataatataatacactgtatgtctttaattcgttgtaactggtggaaaaagagaaagataattgaaaccttaaaacagcagagataagtgatctaagttgtaaatctgttagtaattcaagaacatttagaaatatctcctgataaggttaattgaaggaatattctaatgaatgtagtaaattagttgttcccaatctcaaaatcttttaatattctgaaagaaattaagattttagtgagagatattccactttatggaactacttctttctccctttatctctttatggaaaattctatcttaaggagcaaggtgaatctttcttgttctcttttactgcaaaatatttgtttttaatatgtaactaacctgcacattgtgcacatgtaccctaaagcttaaagtataataatagtaaaataaaaaaaaattgtttttaaagcaaaacaaacttacatagaatcaataatttctgttattaaattatagaatgggaagatgtattgcttattgtgatgaccctcaaccctggctgcacattagaatctcctggaatggggcttccaaaccttagtgtgcttgtgaatcatctagggagtttgttaaaatgcagattttgatttaggacttctggggtaggacctgagagtctgcgtttataacaaactcacaagtgatgttgatgcttgattagcctgttctttcattgctataaagaaatacctgagactgggtaatttatgaagaaaagaggtttaattggctcccagttatgcgggctttgcaggaagaatgatgctggcatttgctcagcttctagggaggcctcaggaagcttccaatcatggcagaaggtgaagggggagcaggcacatcacatggcaaaagcaggagcaagtgagagagagtgggccaggggaggtgccacacactctaaaataaccagattccatgataactcactattacaaagacagcaccgaaccatgagggatctgcccccatgatcgaaacaccttctaccacgccccacctccagcactggggattacaatttaacatgagatttggttgggcacaaatatctgaactatatcctgccctgcacctcccaaatctcatgtgattcttacattgcaaaatacaatcatgccttcccaacagtcccttaaagtcttaactcattccaacattaactcattccaagtccttaactcattccaacattaactcaaagtccaaagtcttgccttgagacaaggcaaatcccttccacctatgagcttgtaaaataaaaaaaaagttagttacttccaagatacaatgggagtataggcattgggcaagtattcccattccaaaagggagaaatcggccaaaagaaaggggctacaggtcccatgaaagtttgaaacccagcagggcagttgttaaatcttaaagctctaaaataatctcctttgacttcattttccacatccagggcacactggtgcaagtggagggctcccaaggccttgggccgctccacccctgtggctttgcaggtttcagctcccagggttgttctcacaggttgttaaatacttgcagcttttctagacagagggtgcaagctgctagtagagctaccattcttgggtctggagggtggtggcctacttctcacagatccactaggcagtgccctagtggggactttgtttgaaggctccagcccacatttcccctttggcactgccccagtagaggtttactctgagtgttttgcccctggagcaagcttctgcctggaagctttctcaggcatcccctgaaatctagacagaggcccccaagcgttcatcacactctcacattctgtacatctacaggcttaacaccacatgggagccaccccaaggcttatatactccaaagtggcagctggagctatacctgggcctctttgagccacagctggagctgagctggagcagccaggatataaggagcagagtccctgggcctggcccacataaccgttcttcccttctaggtctctgggcctgtgatgagaggggttgctgtgaaggtctctgaaatgcctttgaggcttttttcttgttgtatttgttatcagcacctggctcccttttaattatgcaaatttttaattttgcatcaaattaaaccagcaagtggttgctccatagcctgcttgaattctccctaaaaagctttttctttctctgccacatggccaggctgtaaatttttcaaactttcatgctctgatttccttttaaatattaggttgatgccaaacaatcacagtttgcaaaaacaattacttttaattgcaaaaactgcaattgcttttgcaccaacctaatataaattccaactttaggtcatttttttgcacccacatcagagtgtaggctgttagaagccaccaggccacatcttgaacactttgctgcttagaaattttctcttccagataccttaaaccatcactttttagttcaaacttccacagatccctagagtataaacagaatgcagcgaagctctttgctagggcataacatacatgagctttgctacagttcccaattaagttcctcttttccatctgagaccttgacagcctggccttcactgtccatatctctgtaagcattttggtcacaaccatttaaccaatctctcagaaattccaaactttcccttatctacctgtcttcttctgagccctgcaaacacttccaacctctgcctgttactcagttccaaagttgcttccacattttcaggtatctttatagtaatactccactcctggtaacaattttccttattaggccattcttgccctgctataaagaaatacctgagactgggtaattaatttatttatttattttaaaaagaggtttaattagctcatagttctgcaggctttagaagaaacatggcactggcatctgcttagcttctagggaggcctcaggaagctcacagtcatggtggaagacgaaaggggagcagccaggtcacatggtgaaagcaggggcaagtgacagagagaataggtaggaaggtgccacacactttgaaatgagcagatctcagaagaacttacactgactatcatgaagagatcaccaagccataaaggatccactcccatgattcaaacatctcccaccagtttccatctccagcactgtagattataattcaacatgagatttgggcagggacaaatattcaaactatatcatgtaggctttacaggaagcatgatgctggcatctgctttctaaggaggccttgggaagttttcagtcatggcagaaggtgaaagagggagcagatgcatcacatggcaaaatctggagcaagcaatagagaatggtgggggagggggacgacacacacttttaaatgaccagatcttgtgagaaagcactatcataaagacagcaccaagcaatgagggatcttcccgcatgatccaaacacctcccgccagactctacctccaacatagaggattacaatttaacatgagatttgagcagggacaaatatccagactatatcaatgctgttggtctgtggaccataatttgaatagcaaggagagagagcttttagaaattaccaatacaaaggccaagacacccatatatttggattcatggtatctaacacggggtccagaaatctgcatgttaacagaaacaacatgtgattgtaatgcatataatccacagatgggagtttggtctggctagaaggcagtactagccctgattgtgtacaggattagaatcccatgcaaatcattaaggctgtaattcctgtgcctctgtagtcttaatatttttatagcagatgctgatgtaaaaaaccactattctgggcattcaggaaagaacactatcattgtatgaacttagtgaaatgatgtgggaattttgagtgtatgcacaatcataaggttgtggttcatagctattaattgaatctttcttaaaatgtttttttgtataaatatatgggatacaagtgtaattttgttacatggatagattgtataccggcttgtatactggtgatgtcagggcttttaggatatccatcacctgaataatgtacattgcatccactaagtaatttcccatcatccacccaccctcccatctccccacccttcatgtctccattgtctatcattccacactctatgtccatgtgtacacattgtttagctcctacttataagtgagaacatgctctcttgctaccaattaattttttctttaagaattttcagattttactttagatatatgtgcaggtttattatacaggaatatagcatgaggctaaggtttggagtatggatcctgtggctcagatagtgagcattttacccaatgggtagcttttcaacccccattcctcttcctcccttcccacctctagtagtctacactttcgattgtttccaaatttatgtccatgtgtgctcaatgtttagctcccacttataagcgagaatacatggtatttggttttctgtgtctgtatttgtttgcttaggattatgacctgcagctgcattcatgttgccgcaaaggacatgatttcatcctttttatggctgtgtagtattacatcttgtatatgtaccacattttctttatccaatctaccactgatgggcacctgagttgattccatgtctttgctattgtgaatagcacagcaattaacacatgactgcatgtgtctttttggtagaatgatatatttttccttgggtatatacctaataattggattgctggattgaatggtagctctgttttaagttctttgagaaatctccagactactttcctcagtgactggactaatttgcattcctaccaagagcatatgagcgttcccttttctctgcagcctcaccagcatatgttgttttttgactttttaataagagccattctaactgggtgagatggtatcttattgtggttttgatttgcatttctctgatgatttgtagtgctgagcatttttccatgtatttgttggctacttgaatgtcttcctttaagaagtgtttgttcatatcctttgccattttttaatggggtttttttttgcttgttgatttaagttccctatagattctgttaataggcctttgtcagatgcatagtttgtgaatattttctcccattctgtaagttgtatgtttactctgttaatagtttcttttgctttgcagaagctctttagaaataagaaatgttgccaattaaataatgagatactaattatgagaagacttaatctaattttaaagatgttaaaaattttttaaatatgccctggagtcaatgaagtatattattcaattatggaaattctctgtacatagaacagttcaggaacacaaagttatctaaagagagtttggatttttacatagctcacctattttttattataatgtttctcatatggacaatgtatagtcaaggtgaaaacacagttctaattctgttcagggaaaaaaatagtagaaattagtttcctccattctgttctatattactatttaaatttagtttgttaaaggcttaaagtttaacttcacaaacatacaaaatcatagttttttgttaaataacaacatttgaattgtataaatatattattgtatttcttaatttataaactatattagcaactagaaagaaaaaaaaatgacttagaagatattttacacatttacttacattctttatgcaacctgaaccctcatctctttttaacattagggatgacagtgggtggacagtgggtggatctgaatttttaaagttattctctagcaactagaggaaaaatcttaccagattatataggctagaactcttgattgagaagacagagtattattaaggttctgaaagaagagcttttcattattcaccagcaggttttactatctaaaatagaattacatgaatttgtaaaatttgtcaccaaaagcttcatctacttgtaaataaaaaaatcctctcaatttttggccaggtgcagtggcttacacctgtaatcccagcactttgggaagctgaggtagatggagctcttgagcccaggagttctaaaccagcttgggcaacatggcaaaatcccgtctctacaataactgcacccttaaaaaaatagctggtggtgtatgcctatagtcccagctacttgggagactgaggtgggaagatcacttgggctctggagttcaaggcgatactgagctgtgattatgccactgcactccagcctgggcaacagagcaagacctgtctcaaaaaataaataaataaatatataaatatataaaataaaaaaataaaacttctgtcaattttggataggtataaacatcatgaaaaatagtttgaaaatttataactgagaagttgctgaaaatccttgatcggatctctgcttgcaatttctgcataaaagattttgagaatatatgcaatgcaaaataaagcattccatattttaaaagaaaaatattttcttgtcttaactatgtatactttttttatttgagagaagttgctcaaatataatatagttgttgactcaagagaatcaataaaaaaaatctactgaataaataacacagtttataaaatggttagttatgacatcattgccttcctcatacaaagaatgacctgttagaaattctaataaaaaagaatcctcttgtagtagcaacaaaaattataaaatgcctaagaacaaattttaatagagatatagaggccctatacagttaaaaattccaaaatgttaataatgagattataatacttgaataattttttaaaatacgtttaatttttccataggttattggggtacaggtggtatttagttacatgagtaagttcttcagtggtgatttgtgagattttggtccacccatcactcgagcagtatacactgcaccctattgatagtcttttatcccttctcccctcctacctttcccctcaagtccccaaagtccattgtatcattcttatgcctttgcgtcctcatagcttagctcctatatagcagtgagaacatacgatgtttggttttttattcctgagttacttcactaaaataatagtcgtcaatctcatccaggttgctgcaaatgccgttaattcattccttttgatggatgagtagtattccatcgtataaatatatataccacagtttctttatccactcgttgattgatgggaatttaggttggttccatgattttgcaattgcgaattgtgctgctataaacatgtgtgtgcaagtatctttttcatataatgacttcttttcctctgggtagatacccagtagaggaactgctggatcaaatggtagttctacttttagctctttaaggaatctccacactgttttctatagcagttgtactggtttacattcccaccagcagtgtagaagtgttccttgatcaccacatccatgccaacatctattgttttttgattttttgattatggccattcttgccggagtaaggtggtatcacattgtagttttgatttgcatttccctgatcattagtgatgttgggcattttgtcatatgtttgttgtccatttgcatatcttcttttgagaattgtctattcattccttagcccactttttgatgggattgtttgtttctttttttgctgatttgtttgaattcattgtgattctggatattagtcctttgtcaaatgtataggttgtgaagattttttcctactctgtgggttgtctgtttactctgctgactgttccttttgctgtgcaaaagctctttagtttaattaagtcccagatgtttatctttgtttttatcgtatttgcttttgggttcttgatcatgaaatctttgcctaagccaatgtctagaagggtttttctgatgttatattctagaatttttatagtttatagttttatagttatacttaagtccttaattcatcctgtgttgatttttgtataaggtgaaagacgaggatccaatttcattctcctacatgtagctagccaattatcccagcaccatttgttgaaaagggtgtcctttccccactttatgtttttatttgccttgttgaaggtcagttggctgtaagtatttgggtttatttctgggttctctattctattccactggtctatgtgcctatttttataccagtgccatgctactttggtgactatggtcatatagtatagtttgaaatcgggtagtgtgatgcttctagatttgttctttttgcttagtcttgttttggctatgtgggctctttttttgttccatgtgaattttagaatagtttttttctggccaggtgcagtggcccacacctgcaatcccagcactttgggaggctgaggcagagggatcacctgaggtcaggagtttgagaccagcctggccaacatggcaaaactctgtctctactaaaattacaaaaattagccaggtgtggtggtgggcacctgtaattccagctactggggaggctgaggcaggagaatagcttgagcccaggcgccagaggttgcagtgagctgagattacaccattgcactccagcctggtgacaaccatgagactctgtctcaaaaaaacaaaacaaaacaaaacaaaaaaccaaaaagaatagtttttctaattctgtaaagaatgatggtggtattttgataggggttgcgttaaatttgtcgattgcttttggcagtgtggtcattttcacaatattgattctacctatccatgagcatgtgatatgtttccatttgtttgtgtcatctatgaattttttcagcagcgttttatagttttccttgtagaggtctttcaccacttggttagtatatttctaagtttttttttttgcagctgttgtaaaaggggttgagttcttgatttgattctctgcttggttgctgttggtgtacaggagaccttctgatttgtgtatgttaatcttgtatccagaaactttgctgaattctttgatcagttctaggacctttctggaggagtctttagggttttcaaggtaaaggatcatatcatcagcaaacagtgacagtttgacttcccgtttaccaatttggatgtcctttatttctttctcttgtctgattgctctggctaggacttccagtagtgtgttgaagagtagtggtgggagtgggcatccttgccttgttccaattatgagaggaaatgctttcaacttttccccattcagtattatgttggctctgggtttgtcatagatagttttattacattgaggtatgtcccttatatgccgattttgctgagagttttaagaattttaatcataaagggatgctggattttgtcaaatgctttttctgcatttattgagatgatcatgtgatttttgtttttaattctgtttatgtggtgtatcacatttattgacttgcatgtgttaaactatccctgcgttcctggtataaaacccacttaatcatggtggattatctttttgatatgttgttggatttggttagctactatttcgttaaggattttagcatctgtgttcttcagggatatcttcagggtctgtagtttttttttttttctttctttttttggttatgtccctccctggttttggtattagggtgatgctggcttcatagaatgaattagaaagggttccctctttctctatcttgtgaaatagcatcaataggattggtaccaattcttctttgaatgtctggtagaattctgctgtgaatccatctggccctggactttattttgttggtaatttttaaattaccatttcaatcttgctgcttgttattggcctgtttagggtatctatttcttcctgatttaaccttggaggtttgtatttttctaggaatttattcatctcttctaggttttcaaatttatgtgcataaaggtatctcatagtagccttgaatgatcttttgtatttctgtggtgtcagttgtaatatctcccgttttgtttcttattgaggttatttggattttctctcttcttttcttggttgatcttgctaatgatatatcaattttatttatcttttcaaagtaccagctgtttgtgtttcatttatctattgtatttttcttgtttcaatttcatttagttctgctctgatcttggttattttctttcttctactgagttttggtttggtttgttcttgtttctctagttccttgaggtgtgaccttaaatgtcagtttgtgctctttgagtctttttgatgtaggcatttagggctatgaactttcctcttagcactgcctttgctgtatctcagaggttttgatagattgtgtcactattgtcattcagttcaaagaatttttaaatttccatcgtgattttatttttgacccaatgatcattcgggaccaggttatttaatttccatgtatttacatggttttgaaggttccttttggagttgatttccagttttattccgctgtagtctgagagagtgcttgatataatttcaattttcttaaatttattgaggctcattttgtggcctattgaataggccacatgtgctgttgaatagaatgtgtattctgcagttgttgaatgaaatgttctgtatatatctgttaagtccattcattccaagatatggtttaaatccattgtttctttgttgacttcctgtcttgatgacctatctagtgctgtcagtggagtattaaagtcccccactattattgtgttgctgtctatctcatttcttaggtctattagtaattgctttataaatttgggagctccagtgttaggtgcatatatgtttaggattgtgatattttcctgttggacaaggccttttaccattatataatgtccctctttgcctattttttcactgctgttgctttaaagttggttttgtctgatataagaatagctacctctgctcgcttttggtgtccatttgcatgaaacgacttgttccacccctttactttaagtttatgtgagtccttatgtattaggtgagtctcttgaaggcagcagatagttggttggtgaattcttatccattctacagttctgtatcttttaagtggagcatttaggccatttacattcaatgttaatattgagatgtgagttaccattccattcatcgtgctatttgttgcctgtataccttggttttttgtttttgtttttgctttttaaattgtatttttattgtataggtcctgtgagatttatgctttaaagaggttctgttttgatgtgtttccaggatttgtttcaaaatttagagatccttttagcagttcttatagtgccagcttggtagtggcaaattctcttagcatttgtttgtctgaaaaagactgtatcttttcttcatatatgatgcttaatttcactagacacaaaattctgggctgatacttgttttgtttgaggaggctgaagacagggccccaatcccttctaacttgtagggtttctgctgagaaatctgctgttaatctgataggttttcctttattggttacatggtgcttttacctcacagctcttaagagtctttcctttgccttaactttagataacctgatgacaatgtgtctaggcgatgattttttttttgcaataaatttcccgggtgcttttcgtggcttcttttatttggatgtctgggtctgtagcaaggctgggccgttttcctctgttattcccctaaatatattttccaaattttttatttctcttcttttgcaggaacagtgattattcttaggtttggttgtttagcataatcccagatttcttggaataagaatattttcttattcttttttctttgtctttattggattgggttaattcaaagacttttgagctctgaatttctttttttctacttgttcaattctgttgctgagactttccagagcattttgcatttctatatgtgtatccaatgtttccttaagtttttattgttttttctttatgctatagatttccttgaatatttctcccttcacttcttttattgttttttggatttccttgcattgggctttgcctttctctggtgcctccctgattagcttaataactaacctcctgaattctttttcaggtaaatcagagatttattcttagtttggatccattgctggtgagctagtgtgattttgggggatgttaaagagccttgttttgtcacattaccagagttgtttttctgtttctttctcatttgggtagcctctgtcagagggaaggtctagggctgaaggctgttttcagattcttttgtcctacgaggtgttccctggatgtagtactctccccgtttacctatgggtgtggcttcctgagcagagctgtagagattattatttctcttctgggtctggccaccaatatgtcttccaggctctgggctggtactgggggttgtctgcacagagccctgtgatgtgaactgtctatggatctcacagccgtggataccagcacctgttctggtggaggtggcaggggggtgaaacagactctgtgagggctcttagctttgatggtttaatgctctgtttttgtgctggttggcctccgaggccaggaggtggtgctttccagagagcatcagctgtagtagtatggagaggaactggcagtgggccaggcccttgagctcccaagagtatataccctttgtcttcagctaccagggtgggtagtgaaggaccatctgatgggggcagggtaggcatgtctgagctcagactctccttgggcgggtcttgctgtggctgctgtgggggatgcggatgagatttccaggtcaatgaaattgtgtacctaggagaattatggctgcctctgctgagtcatgcaagttgtcagggaagtggaggaaagccggcagtcataggcttcacccagctcccatgcaatctgaagggccagtctcactcccattttgcccctgatagagcactgggtctgtttccagatagtggggaagcagagctgagagcttgtcccagactacctgcctccaagctgcagaagaaaaggaggcttctcaactggttcaaattgttacgaagttcagctggagacttccttctccctgtggcatttatcccgtgccactggaccccctcccaaagtatccctgtgacactcccatggtctttcctgctgcttcctctacccctgtatttcactgggctctctaaattgattcagctccagttaaggttggaatcttctcccacagactagacttttagtttccccagtgtgggtgtgagtttaggggtggaggatctccctttcccacttccgcagtttgggcactcacagtatgtggggtgacttctgggtcctgcaggagcagtccgtttccttcagaaggtctgtgggtcctcttgggattcctgatttattcctgcagtcattctggagctaaaactcatgatgcaagcctccacatgctgctgtatccatgcgagtccaagctgcaatctagtcctgcctcccatctgccatgacgatcctaggtatagtcatatctaatacctgaatcatttagaatatatgtcatatctctagataagaagactaaatatcataaaatatctattttctctaaatcagatccaaatgaatttttttcaaaactcaaatgcttttaaaattaatttgcaagaataaatttctaaaatgtcatacacaatttttgaattaaaacaaataatcagtgtagacttcctcactaaaatttaaaatttcataaagtttatctgataaaaaataactcacaggagcacttgcatagaaaaagactaataactcagtgacacacaatatataggaacaaatgcaagcattttgggagaatttagtacatgatgcacatattatttaaaattggtggaattaagatgaattattcagcaaatgtattggaataactggctattaaaaataacattcaattttatacttcatatttttactccaaaatatattccagatataataaatatttaagtgtaaacccagaaacaatgtaagtactaaaaggaaatataggtgaatatttttaaaatcttgggatgggaggaaggtctttcaacgtaggtgatcaaggacaaagttaataagaatattgatagatttaactgaatgattttataatctttgcactaaaatcagcatataaggataaaatacaaataatatgctaagaaaatatttcagggtatataacagatgagatgcatcattaataggagttattacaaattaataataaagtttacaattctaacaaaaatgatcagtggcatgagcagggaagccataaaagaaatgtaaaggcacaaaaaacatgaaaagtaaccaaatacactgaaattaatggagatcttgtatcagttagctatttttgtgtaacaaacattcccaaaactcaatggttacaacagcaattatctgttgtaataatttacatttctttttgttgtctgagggtttgttggctgctttaggatgagcttaactgagcttgctcttgtttctgtatgcaggctgggggcctgtctctaagttgggctttcctgggacaatttagctggggcattcctgctccatttgtctttcatactctgcaagggctccatgtatttctcatcctttttctgggaccaatgagccagcccaagcatgtccttcttgtggaaatggcagaagtacaagagtgcaagcctagctggacaagtgtttcttaagctgctgcttgtgtcacatatgctaacatcccattggctaaatggcaattacatgaccaaactcagaatcaaggggaaaggaaatatatcttgtcttttaataggacaaactaaaaagtcatatgataaaggacatggatacaagcaagtgcaaagatttggggccattaatacaatataccagatgccgtcttttgcacgttggttagtagaagtgttttgtttttgttttttttttttttaaccttgcttgtaatagtcagtgtcgtcaagagtgttaggaaatgagtactcccacacactgctgaaggtgggagtctaaatggctaattggagtgacaatttgagtgtgtgtttcaaaattttattaaaggtgtgtgttttgggctcaatacttccatttttaagaatttactacaggaaaataattaggcaaatgtgcaaaggttgtataagtataaacctggttaatatagagccagttgtcatggcagcaggaggccatgtggagcagcggctgccatcaatcctggctgcagcagagaggtgtggctttggctgtatgcttcatggaactggtgggaactgggaacaagtgggagccctgccccttctgagttggggcaggagctccctgggtgccactgaagatgcccaagccacagcagtagacctgggcattcctgtgctctttgggcccaggagcaggcgggaggctcaccctcctgggcatagctgcagccactcaaactgtggctgcaggcccatgcctcctgctccatggagcaggcaggagccccatcccccagagtgtggctgcagctacccaaaccgtggctgtagacccaggcatctgtgcactcttaggcggtcttgagaaggcccccactgatcttacgggctcagaagtacctgttcccactgcctggtttctctctgctgttagcacctgcttctttcttggagcaaagatagggccaagcccaggcactgtcacagcccagctgggtgtgtgcacacttggggcagtgctgacatgccagcccctggtcaccttagccccctccagactttgggcactgatgagcataggaggaaagctgaggcaggctgagtgcagctcagtgctggcctgcaggtaccccttggcttctacagcctgggtgccctgaatgacagattgaggtagacaggttactggatggaagggggcaggtcacaggtgaggtcccagccttcaaagagagcctgaaggctggggactaggctgccagtaccgccggactggagtggaaacttgtggtgcattttccgggcctgcccatggccacccatggacaaattggtgtacacttcctcccctctgaggcccataaaaacccctggcttagccaaagcttagcagatattgaggtgaccagctgcatagaggagcaacacactctagggcctcctctctgctgagagctatagagacaatgagatgacctgcctgcagagaggagctacccactttagggcctcctctctgctgagagccacagagatgaaggagagatgacagggagatgatgggactacctgcctgcagagaggagcaccccattctagggcctcttctctgctgagagctgcacagacaatgggacgaccagctgcagagaggagctaccttctctgctgatacctgaatacttgtcaggatgacttgccttgaatacttgtcaggatgacttgcctagcagaaaggagcaaccctctctgctagaagctgaacacactttggggaaaccctggctgtggaaaggagctgccctctgagggtttcctctgagccattttattgctcagtaaacctcctcttcaccttgctcaccctacactttgctgcatacctcattcttcttaggtgtaggacaagaactcgggacccactgaatgaggctaaaagagctgtaacacaaatgaggctgagatatgccccattgctcaccacattgcaaacaaagagaaggaaagaagagctgcagcctttcagagagcccagacctgtgagctccccaagccagggctgtgactccctctttgggttcccggcatttccaagctactgggcatcaccatgttccctggtgccagctgcggaagctgctttcggtgcacctggtccagccgcagccttgtggaaagccgactctcatgctggcacctggagcttcctgccttgctgcagcagctggcatgtctgactgcacagtggctggaccccatgctcactcacatatcccttgtgctccacacagtctcccttggcagatgtgggatccaggctggtagtgtgagctgagcgcatcctgccaggccaagtgggcggaatgagcccagcgggcctgagtgaaactcaaggcaaaggcatcactggccacagaggtttctggccagaaaagtgacaccccaaagatcctgtaacagttgcacatgtaaggctatactttttaaaaaagttgacatcaattttgattgattgattgatatttcagcctgttatatattttaaatatcacctctgagttcaatgatattaatcactagattgtttataatagtaaacatttggaaaatttctaagttccattaatataaaattgataaaaataaatgttggtacatccacacaatgggttgctatacaactgttaagataatgatgcttgtatttattgtcatgaaagaaatccatgccataatgattaaatgtaaggtaggggcttgtttcaataatatatatggttgtatgttcattaaatatatgaaaaagtatttatcagggtatttctatgtggaaaattatgggtgcttttattttcttattgtgctttttaatgttttatttgtagtgtcatgcattaacaggcactttttatgaccattaaaagacagaaagtctacttctatttttgaaaagtgatattgagaatttaattgtaattagtttcaaggaaagcgtatgagtaacaatactctgttacaaagtcaaaacattccgtagaaaatagctatgagtcttaaaggaaagacttctctagtcatatcataaatgatgtctgtttcccttttgagcaaagagacacaacttaataaaattaataggggaaactcaaatgtatagaaaatagaatatgagtaagaaaggcatggatacttttatgctgtttatatacacatgtacacccagccatgctttctgtaaaaatagtgcttgcttggttctgtaaaaggaggaaatatttcagagtttatggcaaaatcattttggaagtacagaaggttggtttggaaaggattacacatttgtcatactttctttcatgcttaataaaaaaagtgattctgatctgatgaatggaacattgttagaagtcagaaaatattactgtttctcattatacttttcatttgtcacatgactttaatgaaggaccctcctgttagcatgagagtcattatcaaccaaaggtatatagaacgtttcctctttaatgcagacatttaacaaactaatgaatactaaaaataaaactctctaaaaataatgttgcttatatactgtgaggatctgctaaatcttttctgcttttgaatacacagtaagaaaattaatttagagcttaatcagccatcataagcagcagcaggtaattttatttaatttttcaaagcaatgagagactattggagtgggagcaggcatgcaggtaataaagaactctttgatttttattgaaacatccataatttaaatgacaggttttgcggattcaagactagtggtttgcagagggtgctctgcagagcctcttgggttccatgacattaccttggggcccactgagggtggtggttggaagaggaggaggctcctggctcccatgtccacatcctccactgtagctctaatttcataggttttgtatttcaatgttctgtgtgagttggcgtgaaaaatgagttctattgcaaaaatagttttgaaaacctttaatttgttccatctccacagtgtgtagatgaagaaacagattcaaagtagactcctgctctattttagtgattattaactcctggtaggtgtaagaatgcacaaaatgcttcagtcatcacaccaatcctgttacctaggctgagtaaatatcagcaccattgtttgccagattaggaaatggacactcagagggtttcaacaatctgcccacgagatggtatgcctaactcctagtcctgcttctcctccttctattccttctttaaagtactttttatctgaccaggctgtgtggttctctatgtttgtacatgttccaacccagagaagttgtagtgtataattgatagtattttaaaatgattccactgaagctgccattattagaaatgattgatctctaaacagcagcactatgtatgaatatgtccaataatgacaaactctaaccagtaagtgctcagaatagtgtgaaagttttatttagcaattttacaagattggtgtggagaatatatacaaattgctttctgtgtttttcttttttagcaggttttaataaatgatatatttataattttaaaagttatattaaagacctataatttgaacattgtagcattgcaagcataaatgttctttatgtttacaaaaaacctcaatggtattcttgattttaaattggtctttgtgtatattatattcctctcaagtgcactaaatttctatagattctgtatgttcattaaaaatatttgctcagttcaattacagttattgggattaggggtagcgggtggggaaaatgtgtaagttcctgaggcttccctaaatgggatgtcctctctgtggattgagacatgtccaaaaacccacatcgaaccttcaaggatctattacttgaggggcctgagagtctatgaaaaacaggcattttaagaagagtcctggctcaaattttgtttcatatctcgtcatatcaaaataaataagaataaaaaattacaataattgtgttatttttctatgtgaatatatatacacacagcagattttatttaaccatttcctctgttattaaggaacttaaaacatttaagatatttccgaatcttcgccattgtttaaaataacactgaaatgagcatctgggtgcatatgtaattgcattcatctctaataatttccattggaaagattcctattaatgacattgtcgtactaatttactctttcatcaatttaaaataatccttatactgccaaattttactaatattgaattatacattattttactaatattgctgatgaaaaattgtgtcctggtgactttttttcatatatctaccagtatgtttttgtcatctgtaagtggcatggagagcttataatttttgacatctctgatttatgtaaaatcatatatggaattagagaacctatgacattaaattaggttatctctggattgagaaatggtgatatttgttttcctcattctttttgtgagtttctgcccataaaatattttataataaaaatgcaaaaaagatgaaggtatctttttttacaaaacagcatacagtaagacaagattcatgtgtattatctaacatttatgaaattttattattaagtgtttttagaggacttattcaacatatgaaggattttagtcagtagacacagtgcctcttcacctgcactggaggcgttgtttttcttctctgtagcagggtgaatggggtaggatggtaaaaatttccactgagaatgtagcaaacttgatgtcttcaaaacagctccagcatttgtgagatgatgaatactccacatgaaagaggagacacagcgcagtggttagtgcacagccctggagtcgaaatccttagatattactccaggctttaccacttcttatgtgaccttgagcaagataaattttttatgcctcagtttcctcatctgtgaaatggggatataaacagaacctatatcttaagggtattataaagattaaatgaggtaactatgcagaaaacgtttagaaattctgacaataaattgttttaaaatggcaattataactttagtaagtggtctcatattctctctttttttaaaaattttactttaagttctggggtacatgtgcagaacatgcaggtttgttacataggtgtacatgtgccttagcagtgtgctgatcacggtcttcttatgcacatttaccaatttcagtttgttgaaagacacaattatcagatatttgaatgtggatgaggtttgttgtaattacaatttcacttgccttttgtgaatgtttctgtcacaccagggcatggggatgacatgaacaaaggcagagcagtggaaaagcataaacttgttcagggaatagtaaaaaatctaggtaaatccacaacataatgctattgtaacatactattaattatgttaattaaacaattattcatgtttggtcttcatgtcaagatgaaatatatttaaatacttgactttataacatatataatattgatgtaatatcataaaatatttgtaaaataaacacagttatataccatgtaaatatatttcatgtattcattctaatctaccgccaagtagtaaagtttcagatttttttttttttttgagacagagtcttgctctgttgcccaggctggagtgcaatggcatgatcttggctcactgcaacctccgcctcccaagttcaagcaattctcgtgcctcaccctcccgagtggctgggattacaggcgtgagccactacgccccactaattttggtatttttagtagagacggggtttcgccatgttggtcaggctgatctcgagctcccgacctcagatgatccgcctgcctcggccttccaaagtgctgggattacaggcatgagccactgcgcccagccttggataatttttaactctggaggagcagaaatgaagcactgtccggaataattttcctactagagaagcaagtgatgaccctgcgttacaaggggtttatatgctggcctagtatctatgttctctagatggcagtggtaggatctcactcccataacacccaagagtcactgcattataaggaacctagaattgctttcttttttttccgagaccgagtttcactctgtcacccaggctggagtgcagtggcgtgatctcggctcactgcaacctccgcctcctgagttcaagcaattctactgcctccgcctcctgagtagctaggattacaggcgtgtgccaccatgcctggctaatttttgtattttgagtagagacggggtttcaccacattggtcaggctggtctcgaactcctgacctcgtgatccgcccacctcggcctcccaaaattctgggattacaggcaagcgccaccgtgcccagcctagagttgctttcttaaaagcatccattatgtattagagaatacattacaacatttgcgatgaataatcaagcaaagattcaatatatcaccctgtttaaagtggaaatccacctccaatgattttgctgataatgatagaatgatataatttcaaaaatcattcttttaatttttgcattataaaaatttttgggccatgtgcggtggctcacgcctgtaatcctagcactttgggaggcctaggcgggtggatcacttgtggtcaggagttcaagaccagcctggccaacatagtgaaaccccgtctctaccaaaaatacaaaaattagccaggcatggtggcgggtgcctgtaatccaagctactctgtaggctgaggcaggagaaacgcttaaacccaggaggcagaagttgcagtgagccgagattgtgccactgcactccagcctgggagacagagcaagactccgtctcgataaataaataaataaataaataaataaataaataaataaataaatatttgatatgagtgatggactaaaaatctcaactaaatattcctgggactcttcattctgttctctaacagaaccttcaaagtgtattttggaaaaattccattaacacgctgcctaggctgaaataatttcatgatcagtttcatttttgcactcaccttgtaaatccagacctccaggcaggtgtcgggcagttatcagtggattaatctggtcagctgcttctggttgctgttttaaggttactacctaatgtgtacttttagagactctccctagtgtgctgtcacaaagaagtcgattggatttttatgtaaagaagggctcggtgagcctctaatccttaaatcattcctttgaccacattttatttcattgtaaatggagattaccacacagaggaatatctgatgctgtctggctgatccatttctaactaaacaattaagtcacttgtatgtcagagcatactctcagcaactggcatttccattacttcaggcttaccctgagactattttggaaatatttcatcttctgctattttttttctagacatttgttattttatttttagattgacagacaaaattgtatatcttcatctgtacaacgtgatgttttgaagtgcatatgcattgtgaaatgaatgaatgtagctaattaacgtatgcattacctcacataatcatcacgtttttgtggtgaggacacttaacatccactctctgagcattttgcaggaatacaatatattgttattaactctggttacaatgttgtacaatagaactcttcaatttattccttctatttaactgaaatcttgtaccctttgaccaatgtcaccccaagcaccccacctgcaactgcaactgcccccactcctctactctctagttccaggagattaatttttttacattccacatatgaaggagatcatatatttgtctttttgtgcctggcttatttcacttaacataatgtcctttaggttcatccatgttgttaaaaatggcaggatttccttctttttttatggctgaatagtgtttcattatgtttctatatgacagtttctttatccattcactgatggagtcaggtggattccatttttttggctattaggaataatgctgcagtgaacatgaaagtacaaataactctgacatactgatttcatttcctttggatatatacatgattatatccaccagtgggattgctggattgtatggtagttctatttgtaattgttttgagaaacttctatattgttttccataatggttgtactaatttttattcccaccaacagtgtgcaaggtgggtcattcacatcctggccaacacttatcttttgtctttttgataatagacactaatgggattttctcatacacatttaccaaacttcagtttgctgcagaacacaattaccagatatttcagtgggggcaagggttgttgtaattacaatttcacttgccttttgtgaatgtccctgtgataccaaggcatgggaatgacatgtgtagaggcagaacaatatcactccataaagatatcatctctcattgtgattttaatttgcattttcctgataattagtgatgttgagcatttttttcacataccagttggatatttgtatgtcttattttaagagatgtttatttaggtcctttgcccatttttaaattgggtttttcgttttcttgacttaagccccttaaatattttggctattaaccctttatcaggtgtatagtttgcaaatatcttctcccattgcgttggttgtttcttcactctgttgattgtttactttattgtgcagaagctttttactttgatgtaatactgcttgtctatttttgcttttgttgcctgtgcttcgggggtcatatccaaaaaatcattgcccagaccaatgtaatagagcttttcccctatgttttcttccagtagtttcatagcttcaggttttacatttaagtctctactccagtttgagttgattttcgtatatggtgtgagagaagagtctattttcattcttttgcatgtggatattcagttttcccaacaccatttattgaagagattgtcctttcctcactgtgtgttcttggcacttttgttgaaaatgagttggctggaaaagcctggatttatttctgggctctctattctgttccacttgttgtgtctgtttttatgcctgtaccatgctattttgattactatagatttgtagactattttgaattcaggtagtgaatacgtgctaattttcaattagcagaaagctcaagcaaaacaccctgagtataaatgaagcagctctttatgtggccttcacgaggattggactctcatagggcttggtttttgtataactcttagttttaactacatcctaaggttctagagaaaattctggagctgagacttagctatgcatttgtacaacttccttgtctgccaatctaaaagtcaatcttactgataatccctatttttcttttattcttatttcctcttaccattgtttagtagctaatatactatgtatttcacttgcttatgtgtttattgtctgtcaaccccatcatagctccatgagcatagcaccacgggggcagaaattatctactttgttcattgtcatagtcacagtgtcaagaaaagtgtctggcacattgcatgtgtataataaataattttgaataacagccagtcaccctattttatatatcctattttagtatcttggcatgggagataatttcatgagtatttatatatttgcaaactttggaagaaaaaaagaaaaaacactctatagaaggcaaattgagaggactgaaagtttagaagtgacaaacaacctagaaatagctacacatttttagtgatcaaaatcaatttttgtcattaatctggatttactaacttctcaaagttatcatggatgtaaaagtggctttaatctgctgatgctctgtggtgttctacaaaattgctaaattgcttttatgtgaaactggataagacataacccttctcctaccttttatattattttttagccatgagccaaatttttctagctaagccaatttaaaaaatattagaaatgcaaatgtattgccattgttctaaaatgtagttttaaaattccatttttcaaggtgggatttgtgattatgtgtgaggcgcttcattgtctctcagcacttcccaaccaaaatcagtccattttgccactcctgaggaaaggtctgctctgtgtgactcacagttacttccatgaatatttatcctgcctgtactgttggaatcaccttgagatcatgtacaattagttagggttgatagaattagtaatgttactggttgtgttacagcatctacgggtctcagtgaagtgggactcagtcccttctccccattactctattttctgtcccttcttgattctgcttgccattttgggggtgccaatttatttccttagtaaaaacaacagtagttatatattaagatacaactgtattatttgctttttttcttaaatccactattattttttgtcttttcattgattaaacttcaggcaaaactcatttggctgtgttgaataacattttgcaattttcttttccctgtgtctttcacactttgtagcattgtgctcatgtatactgtctttgtaagttcgaatctattaagtgatggttcgtcataaatcctgtataatacttgattttcatcatttatttatattttgtcacctgtactctcttgtcctgagtacaaagaatacacattcatctctgtaccttttttgtttattgatagtttatactttctttggacaacttttaaatgtatatttatttatatttgcttatccaatcttataaagaacaatttcacaagtagttagtccctgctcatcttcttttgatattcctaatatagtcttgtaatggattacttgggatatttattcctctgtattttaaaatcatgaatctcaaacatctctatccaccaaagaatcttttgaactaaaaaacgcacacagacagaccacatttttgaaggattcaatttcaaaataaagttagttcctacttagccttgcaaaatgaggtatcttctcttgataaagttgtgcaaataatgaatttcaatcattgaatattctaaaaatgtgttatcttgcctaagtaattgtttctatgcctttagctattaaaaatatgaaaacataatcctttataaaagcacatatttttaccttccatttgagtaatttttattagtcaaggaattttgtataggtatatatttggtgaaactttttaataaaattgtgtttttctggttataaaatgatgcagtttcattaaaaacatttataaagcagaaaaatacatagaatataaaaatcatccatattttcatagccagcaaatcattgttatcttaaaagtacatgtctataaacaataatttttaatggaattgggatcatttataagttcatttactacttgtctcttaacaataatgtataatctaatggttagtggaaaattcatcatatgatgttttcactatttaataaattcctcattcttagacatttagattgttttcatatttttcactgttatatataatgatgtgatgaacatttttgaaaataaataatcatagggttttctcttaactgccttacatacttcatttggagttaaatcactgagtaaaaagattcacatctcctcccacactctgccttctcttatgtgatttagtaccttttgcttgccttaatctctttctgcaaagtaagaaagtgatctgaaaaactaatttatatacagtgttgttaacttgtacgtgttttcctgcccctttcccttgctcagctgtcctagaccaattttgggaagcagactccacagacagaggtttatttgcaggagatttagtggggaatgttgtcagcaacaatacaattaagggagtaagggaagggggttgagcaggagaggctgaactcgggtgcaataacaggaaggtctccagccatcccaaggggagctctggagctcagaaggaccctcagagtgttcttgaattgaaatacatctctgaatccaacttcctcctgccactcccattgaccagtccttagtttggtatagggtgccttgggcaaggcagtggacatgctcagtagctgggtaagatgaggacttcatcccaaagtggccgtctgggcagtgaaccactgggtgttcagcgtatcagcctcgtggattttgtgttatcaaccaataaggggagagggggtgaagtgtaagtcaaaacagatgattctccactaggaaaattttagtctttcttgcctgttacctaaattggaaaatgtacatgaggaggatcttcctcagatcttgtcggcctctttctcataatcctgctctagaactcgaaatatcctgctctacgactcaaaaccaaacaaacattgttatttgttggtgaagggggcacctagaagcatttactgaccgagcagtgactttaacattattttatgtatcaatgtcaccagtttagaggatttcactatattaacaagtcctactgtgaaaataactatagtattactgattatataacaaggtgaaatactatattttgaccattaaactatttttttttaacttgggtgacatttagcaatttaccatttccagcaatctaaatgtttatgtcacagaaatcacatattaaattatctggaaatttatttctcaggaggatcaccaaggcatcagaaaataataataattaataacacaactataacaacttgacgttttataaggacaaagtatacaggttaatcactaatattgtaatttttttaacagccattgaactaaattttgacaattgaaaagaatttaattatgaactcctgatgatttgcctcccacctccaaatagtccacccatcattctttatgaaatatttattgtataggggctgggtgtggtggttcacgcctgtaatcccagcactttgggaggccaaggcaggaggatcacttgaggtcaggagtttgagactagtataagcaacagtgtgagatcctctctctaaaatatatatatataatttattgcataggaagtattttggggggatagtttaattactgttgtacctggttgtacttgatgaatattcacattttttctgctctctaaaatgaaaatttagtatcatttaacaacactaagagacatcatggaagcacaattctttattgccgtattttggaataggggtaaataggatgagagttgtttaaaatacattttactctgtctctcccactgagtgaaactatgcatcctggacagaatacataaagcagatatttgaggaatctaaaaaataaataatagcagatgtagtgggaagaagaccagaatttgttcattttttcctctggtatcttctggcttagactcaaggcagcctgacacctgagagagcaccttgtcatagacacacagctgcagacgccatttagttcagactcaaagagcatgaaagtgacctcttgttagtggcagtggtggcagtgaacgctctcagaggctttaaattctgaaggaagagaactttgatttgaggaaatctggtcccaagatggcagagcaaactttcatgctgtttttctatctccatcctcccatcacttagtgtggatgcagcggcaggaagtaggtggcagagaagggggtaaataaaaccccagctttttggctgcaggactgaaaagaggagctcctaggaaccagtaagtaggaaagagatagcacagagggagaagcttgggaaaggggcccaatggagttgtttacaaatttctgagctctttttacggccacagtcctctggtgaggactgatagtagaatagtatgcttgtttatgtccttatctggttggatgcagcctttattatttatttatttattcagcaaaacatcttgtccttgttggcaagatgctctgtgaaatgtgatggagtctttttctaaggcagagtgacttatgttcaaaggctctctttacatatgggctccttacttagttgctcagcatctcaggcttgccatctagaaaatggatagaattctcactaccgtcaagaagtgttatgaggattaaatgaattaatgtacactaagcaactgaacctaacaaatgtttctttccctgtggcatttggtttttagctttcctatccatttcctaagtatcaggcccttaggtttcatgtttagcactcctttaatctgtcaagtttactaagttgtaggataatttagaagcttcctaagaatcacatgttaaataaaaaaagaacaaaggtcttaaaggaaggagtgctaagataaaacctatggtaacctgctgccctttttcttacttctgaagagttgaggttgtcagaaaactaatatttagatatgggcttatctggttcataatattctaaacaacactgctaccattactattattaccaactaaaactatttaggatgtgtcaggtattgacattctacatatattaatttatttaattcttacaataacatgataaggtgggtaccattattattctaattttacagaatacataacaaaaacatcactttattgccctagtcttgttattcatattattaaaaaaacaactattgtgtactggtcttaaattaactataaaattagttaatatttggttatctctttaggataaaaactctagctaaaatgagccttaatatgggcaatgctttttttcctgctccataaaacagaccaaccctccttgcaagcttaaggctaaaaacccagaatgtaataacaactggaatgttggagatgcatcaaggtttttgcaatgtaaattccttccattaccttagttcaggtcctaagcttctctagtttaaattattacgattgatttctttttatttatttatttattggttttgagacggagtctcgctgtctcccaggctggcgtgcagtggcgcgatctcagctcactgcaacctctgcctcccaggttcaagcgattctcctgcctcagcctcctgagtagctgggactacaggcacctgccaccacacccagctaatttttgtatttttagtagagacggggtttcaccatgttggccaggctggtcttgaactcctgacctcaggtaatccacctgccttggcctgctaaagtgctgagattacaggcatgagctgttgtgcccagcctattacaattgatttcttactgagcataccaatctcttcttcattgactgcatactccaccctcactgcttgaattatttttattatttacatgcctggtttaaaaaataatggctgctcaataaagtaggacctttttctttcttttttttttttttgactgagcacaggggactttagtaataggacgtgacaaggtggagctccctaggcccctcccttttcaggtggtctgtgtggaaattgtgaagaggggagatcctcagtgttgtgaggtctgagtgcagcagggactccccagcagctgggggcctctctcttcctcttatactctcgctggggctggtggtccgggggccttattccttggaagccatgtgggccatgaggtccaccaccctgttgctgtagccaaattcattgtcataccaggaaatgagcttgacaaagtggtcgttgagggtaatgccagccccagcatcaaaggtggaagactgtgtgtcactgttgaagtcggaggagacaatctggtgctcagtgtagcccaggatgcccttgataggatcctctgaagcctgcttcatcatcttcttgatgtcataatatttggcaggttttccagatggcaggtcgggtccacgaccaacaccttggcagtggggacatgggaggccatgccagtgagcttcttgttcagctcagggatgaccttgaccattgccttggcagtgctagtagatgcaggtatgatgttctggagagccctgtggccatcaggccgcagtttcctgcaagggccatccacagttttctgggtggtagtgatgacatggactgtaatcatgagtctttcaacaataccagagttgtcatggatgaccttggccaggggcgctaagcagttggtggtacaggaggcattgctgatgatcttaaggctgttgtcatacttctcataattcactttcatcatgaacatgatggcttcagtagagggggcaaagatcatgacccttttggctcccctctgcaaatgagccccaaccttctccatggcggtgaagatgctggtggactccacaacgtactcagtgccagcatcgccccatttgattttggtgggatcttactcctggaagatggtaatgggatttccattgatgacaagcttcccattctcagccttgatggtgccatggaacttgccatgggtggaatcatactggagcatgtaggccaggtagttgaggtcaatgaaggggtcattgatggcaacaatatccactttaccagagttaaaagcagccctagtgaccaggcacccagtatagccaaattcgttgactctggccttcaccttcaccattgtgtctcagggatgtggcaggcgctgtgctgcacaagaaaatgcggctgtctctaatgggagaagggagccaaaatagggcttattctatgcttctaagaactgaatcctggcctcacttatttctctaatgctgtctcctctgactgaaagtaacaaacagaaagcccttgtccagtcacacaaatacagtcatcattcatgcctttgctgcagaatgtatctgtcactcttaattaagttgtgataataattttattgtttactatttattgaggacttacattgtaccagggtttgttctaagccctttatgtggacctattttatagataaaaaagctgaagtttagagaaatagtttgcccagcatcatacattctgtaagtggggttgctgagatttgaactctcggcattctaatacaagcctgagtttttagccatgatacatattgctacctgtttatttctcacattgaagaatggaaaggatcacactgacactgcaaacctaacatatacatcttgtttccaggaggcaataagataaattgcatggaaggtctgttgggaggaatttggatgttgttactgtcccttaccctgaaggtaattattaggtcttttgagcccagagcttggtaacagttgccagtgttgataagccaaaggtggggtattttcctttttcctctggttaaagatcaattcacttctttcatgttttctttttagctgatgataaaggagaagaataaaaggatgacagatgtgaatacttaatcacgttgcttaatattatggagtgacataaaaatatggtttgctttatctagacagatgtggttttataaaataatcatggtctttttgtttgccatgtagaataattatgcacaaaatgggagtgtacattctggaaaggtcatcttgacttttaaagggtttctttaggcattcatgattgtcactttctgatcagtatgggacaagttgggatacataaaactctattctgtgttaaaggaatatttcaaagattccatgtttaatgaaataaagtattgcctagaaattagagacttgtgattacttgcactgattcattctgaagttttctgaatgctcttttaaaaatctgtagctcttagtttcttatttctttcagatatcaagaaatgcggatttccaatgcacttagcttatgctcaatattaagtgaaataattaatttagcatgtccatgatgatactaaattagtaattcagggtagttaaaattgcagtggatgctgaactgatccaagaaacagtttcaaccttgtgaactggtttggaattagtagtctatcattaaatagtaattaaacatcaaaggcttgaaatggcccattatgtgcaacagaaagtttgtgtgttagaataagacacttgaattaatatatatttcataattttatatagcaattatgtggtgataaacagtataattattttattttttatgagttcattgtctacattttatattttacatagtagttatggagaaattgcctactctgtgatgataaacagaagactttttattatttttaaactcactttctaaaaatataacacaaaattggtttattttattttatttatttattttgagacaaggtctcactctgttgtccaggctgaaatgcaatggctcaatcttggcttgctgcaacctccacctcacaggctcaagtgatcctcccacctcagcctcccaagtagctaggactacagatgcaccactatactcagctaattaatttttttttttttttttttggagagacaaggtctcactgttttgccaaggctggtctcacactcccaggcccaagcgatcctctcatctcggcctcccaaagtgctggaattacaggcatgagccaccatgcccggctaattttcttttaaatccctatacagaatgtaatttgaatatggattttgtttttgtaactcatatttgaaaaatgtctcctttaaaaaaatcatacaaatattgaaagtatttgagattttttaacctaaatcaggaatttgttttaacatctgttatcagtcatctgaagccacaacacttggtttttagagccattccactttatgatgtgaacatgcatgatgcatgcaaggaagagtaacatttcatactatgtgcaaaattgtcaaaccttgtatctttggtatgtgggagattggggaagtgaaaaatgagtctgttttattaggggcagtggtatatcatggtgtatgggtcatcattgtgaatcacagggaaagtggcatagcatttgggattgatccacatgccaccagtaaatcttggcccaaatcaaatcgaaatagcacaggaattaagatagttaacatttggcagggcacggtggctcacgcctgtaatcccagcactttgggaggctgaggtgggcagatcacaaggtcaggagatcgagaccatcctggttaacacggtgaaaccccctctctactaaaaaaaacatacaaaaaattagctgggcatggtggcatgcacctgtagtcccagctacttgggagggtgaggcagaagaattgcttgaacctgggatggggaggttgcagtaattcgagatcgcgccactggactccagcctgggtgacagagcgagactccatctcaaaaaaaaaaaaaaaaaaaaaaaaaagctaacatttatcaatggttaattatgtacctggcacagttctaagtgtttaaagtgtattaaatcattaatcctcacaaaaaccttttaaaataaatactgttattaattagataccagcaggggtgagcattgtatagaggagcaaacaggtatggagtggttgagtagcttgctacacaactagaaagtggcggtgctgaaattgaactcgggcagtttggctacccagtcagcactcctaactattttattaaataaatatctccctcgggactttgattgaggtctaagtcatagaaatggtctgttttcctgaatttttcttcgttaagatgaaagttctaacttcctgccagtaaatgtctaatttatctggaatttgtatcttcaggatatttgagtcttagagtttgtttcattgtcccagtggtcagtctaatgttgagcttaagtcatttatgaattcagcccttttgtttttatgaagatgtagaaaatattctatggctttcttttccttttctttttgtagagacggagtctcgctctgtcgcccaggctggagtgcagtagcgcgatctctgctcactgcaacctccgcttccgggtttcaagcaattctcctgcctcagcctccccagtagctgggactacaggcacttgccgccacacccagctaaagaaaatattctatggctttcctgtgggttgctcctaagcttcctccaagatatttcttctttctcctctttccagaagcacagtcacccatctagcttgggctctctttagcctcctctgtagtaatcctaactctagtctccttacaatttattttctagattaacttaagcaatgttctgatcacaaactttactattgtctctccatttatcattatatacaatccaagtcccttaatgtgatagcccaatgtcttgttgctctggatctacctttcttttcttatcttaaaattcttaatcatcatggaagctaacatttattgagcacttactatataacaagcactgtgcttacttccaaacatacaaagatgaagaatagaacctactttctccctttgtgattatcacagggattatctcacttaatctttgtggaaaccatatgagctatgtaatattattaactccattttaatgaagaggagacaaagtcttgaagagtttatgtaacttattcaaggtcacaagagaaccatgtggtagatctgggattcacaccctcacttttaagccctatacaatactccccatgtcataaattttctaactctaacccatctttagacgtatggggctactcaccactccctttatatccctcacttttttctcttcattatcatgttttatgtcattttattctccttgtatgtaggtctcaatttttttccttatttctgcctattgagtaacaactgccttcaacctgtggatataattgacctctcccaccacagaaccaaagcttcatttattttcttaactcccatagtgctataaccttgtatgctgcttatacagactatatgatgagctttatcgagtgctaaaattttttttaagagtaaacgcttctaattatgtgtcataagtaagttctcagagaagctgattcagactttccaccaaagggttgtgttggtacagaaaacataaacatcaaccacattttagcacaattttcatcattctcttgtggtttgacttttctgatgatgtctaaacttagacataaaaggaaaccccgccttatatggatgacatggaatggaaaagaagctccatggctttcctgtttcactggtgggtttgaccttttccacacgtgcatttgctttgaactcctcctaagttaggtgctacgtgaatacaagttataattaacatgctttctttgggtctccttgaacaaaatgttctctctcatgatatgctatgcatatttactttgaatgaataatagttttgaatttggatttagaaagcagataatgtgactgaaatccatgtttcttctttgcctttaatctagggctgcaggatggggcccaaatgtgaagggaataaaacatgagagaaccttgtttagccacgagataaccagggataagagtttagcttataggctctaatcaaacgtgttatttttcattgaaaactggcgtatggtatcactatgcagctgttaaccagctgtttcctttctactggggttcttgtgtgctctctgctttaaatttatgtgttgcttgggatcccgaaggataaaatagtacttgtaggttcaaggtagtggttggaatggttgtttgcatgtttttagattttttagtttaaagcaacatgtttaaaatgttttcttctaattgctattgtgaatatgcaaatgtttatttaatcatgctcaagtgagagaagatatagaaacaattcataggctaattcaaaccatgtttttccctctcttgtttgccctacactaatctgccaagcctgtatgattgtctcagttctccatttagcaccgaagttagttttgaaccctgaaaaaagagacatttatatacttaattatttacatataataataaatatcgtggtcatgtaatggctacttcagtcattttatttccggaattggttccttccagtgggttcttggtctcgctgacttcaagaatgaagccatggaccctcgcagtgagtgttacagttcttaaagatggtgtgtccggagttcgttccttcagatgttcagatgtgtccagagtttcttccttctggtgggtttgtggtcttgctgacttcaggagtgaagccacagacctttgcagtgagtgttacagctcttaaaggtggcgcatccagacttgttcattcctccgggtgggtcgtgatcttgctgacttcaggagtgaagccacagacctttgcagtgagtgttacagctcttaaagatggcatgtccagggttgtttgtccctcccagtgggttcgtgatctcgctggcttcaagagtgaagctgcagaccttcgcagtgaatgttacagctcataaaggtagtgcagacccaaagagtgaacagcagcatgatttattgcaaagagtgaaagaacaaagcttccacagcgtggaaggggaccccagcgggttgccagggctggctcaggtggccagcttttagtcccttatttggccctgcccacgtcctgctgattcgtccattttacagagcgctgattggtctgtttttacagagtgctgattggtgcgtttacaaacctttagctagacacagagagctgattggtgcatttttacagagtgctgattggttcatttacaatcctttagctagacacagagtgctgattggtgcgtttacaatccttttgctaggcagaaaagttctccaagtctccagctgacccagaagcccaggcagcttcacctctcaatttcatgccttcactggcccgatgacagagtttcaccaacagaagaaaatctttcggtttgtcacagtgtgtatggtctgtggtcagatatgtcaaagaatggtaaacaaaggcctgtagacagtatatcagtgctatggtttgaatgtgtcctccaaagttcatgtgttggaatcttaattctcaatgccataggtttgagaggtgggacttttaagaaatggttaggttataagaccacatctggtctcatgaatggattaatgccattagtgcagcagtgaattagttgtcacaggagtgagttcctgatacatggataaatttggtccccttcttccccctctgtcatgctcttttgccttcctgtcttctgccatgggattacacagcaagagggtcctcacaagatacagccccttgattttggacttcccagcctgagccaaatacattcatgagccaaatacatttctttttttataaattacacagtcttaggtattttgttagagcagcatacaacagactaagacaattggaattcctactaaggattcacatggtatggagtttaaacataatggaatatgtttgtgttatcctttttattattggaaggttgagattttattattacaaggttgagattaggaaaataatacctaacaattataacacttactacacactaagttttctacatgtattaatttatttaaccttcttgataagtactgttaacatctttgttttataggtaaactgagacaaaacatgttaagaaaagtgtacatggttacacaacttgtaataatcagagaaggatttagatgttggtaggttagctctttactctgtactagactgccttgagttgttgcaaggagttaataattaatcagattactaatttcagaagtagtccagtggcatgtgcctctataattcctgtgtttggtatgtttgattaacttcccctaaacttttagaactctttttcatgattgctggggagcaccagtgtgggggcagcaaagcttctatctagaagatcagttaagtcaagataaggaattcacagtaggtgtattaggatatatcagggtgtactagtcaatgtcaaccaaatgcagagtgagttgagctgggattactatatcatgctccaacaattcaaagttttcatggggatctctcttttctgaaaccaagtctaaaactctcatacctctcatgtgaatttatgttaaatttcagagcattcaaagattttctcaccctaatgttcccttgaattaactagatcaaactgctgagctcataggaggggcttctgaaatatgtttgcttgtttgcttttgcttttggatagatggataagtggataattgagagaaagaaaaataaagttcatattaataaaattgtaacttgccatatttcattttgttaccaggaagtaatgacagtctttaaatgacttagtcttcctccaaggcattgtctcctgctaagcctcaataggcaggtagggaagagaagctattgagagagggagtgctctatagatagttttcttttttcttcctgaccacagttagcacagaatatggaatcatttaatctccatgttatctttggtgggggccaggaatataaggaggaacagaagctaaaataacaccaccaccaccaacacagagaagctaaaatgaaattactgagttaatgactgagtcctctataacagcaacttaatatattggctgtgtaggccatgttattaaattgtggttccagtgagtatcttagagcaaataactatagcaaaagtactattaaattcttagcaaaccaataaatccatacctgccagttaagggcaaaagatatctaatttacacatttaagatgtatacatgctacatttggtttcagagcattggtttccttggatttaaagtgcatttgtacattaactagaaaaaattggtagactttaacaataaggtgaaatactcaaacctgggaagaaatcagtaggctttaactataagtttaaagagccaaaacaagccaccaaatgaaaaagtgaaagctcatgtgtgctttacacatagcagacgtgctagaaataattgagtaaatgtagatggacatgaataggtggagaaaaacctatgaattaatggcaccaaaatctcaggttctacttggggaacgaggctctgccgtctggggaggtaaagtgagctagtaaaatgacatgatcaaccattgctaggataagctgtttagtcagaacactagctaaggtctcagctaaggagaatgagtaagtggtaatcatatttgagtaagtggtaatcatatttaaagactcagagatcaacagaagcaaactcctttattatttatttgttattattattggggatctcactctgtcaccccggctggagtgcagtggaatgagtatagcttactgcagtcttgaacccctgggctcaaatgatcttcccacttcagcctctcgagtagggtgtaaaccatcatgtccagtgcaaagtcctttataaggtggcatacttgccttgggtaaagacaaagatgaccagtgttggtgagcagtgttatccagtagatccagatgttttgctgtcaagatcaagaaagtaggtaaggcaaaagaacgggcccagtcagagcagaacacaggggctgcccttgggagaaaagtgggactaaacagcatttgggatcagaaaatcattttaatatgatgattcagggtattttactagcccactttcgaattctcttcacctaatcattataaagactcctatggctggtgattcagagagctcacaaagtctaaattgcatgtacaaaaggataaatgtaaaattttgcacttagcttaagaaacaagtggatgatgggtagggagaacaagctcagtcacactttgcaggaaaacaaaacaaaacaaaacattgcattaggaattttaaaatttaatcttaactgccacaagtcaactgtgtgacttttggcacaagatcttttaaaaccttaatttccttatctgagaaagaggatgttggaagaagatcgtctctgaggttcttcctggatttaattttgtagttctatggcgtcgagttttcttttaagtaccaattcatatgaagcaatgttgtgacatgtgatgccaaaaatctaattcattaggagaaatacagagactagattatcctactgtattcagtgtagtcgcttcatttggctggacaatcaagttatggttgccatatattttgaaggatattaaaaaaattataggagatctagaggaagttgactgaggtgtttattattgtagaaacaattgtatagaagaaaacatgagatgaactagggttcattagcccaggccagagaagaagggggcactcagtaactttcttccagtatcccctctcatagctctagatggaaggctgtaggaagattttccctaaaggctacataaaaagaaataaaaagacaaaccttcaaataattgcagtgttccagtagtaaactggattgctttgtgatgaaacgatttccctcacaaggatgatgttcaggcaaaagttgaaagaccatctctgcagggaaagctggatttgatgatcttgagggtcccaggcactcacaggtgcttccatcttatgatttgctcagtcttgacattagttttgaaattacaataaaaacaaatttatgtgctaatatcagaagtgataaatttttatggcaaactattttctgattaatcagaaataaaatattataattgtcaaaactcagacaatttcatttagttctatataaagaactattgaaaacagcaacatgatctggaggtttttacagttcctcttgctccttggcgtctttatccttcaagagcatttctctgagtgtatttctttcacatctaattctgtcttggtgcctgcttcttggagaatctgagttgacctagtaataaacacacaataaatattagcaattttctcttactctttcctctgtgactcaaaagcaatttgttttcttcctgtgaatagtttgtttactgttggtggatatagaattaaagtgagttagaattttatgttgtttttcctaacggaaccatggaaacgttcttgctgtttgatagttacaaaatgcctcctgattttaggcggatagtaacaatttagaattgaattgtaaacagcatttgggaccagaaaatcattttaatatgatgattcagggtattttactagtaaaaatacttaatatcacttagtatttagacttcacatctaactggactagatgactatttatgtgtagacaggacttagaggcggaacagcaggaggaaatgtagaaagtcaaacacctggctagggaaaagtccttacgctgtctggatttggtgtcagcctccgctctgtctccaccactagcatttccagccaatgcatccctgattactcaaagccaagcatttcctgcagagtagcaggagggataggaaacagcatgtgcttcctggtctgggaggtggcacaggactgcggggcagccagtaatagcaaacacctaaagcgggaaaggatttggtgaccctgtgaacagaactttgcttttcagcagaatgacacaatcatctgtagcattttagtctggatttaagtcataactactgagaacacactcactgtagaatctttgcttttggggcaccagtgtaataaggtagacaggactgatactgacttactcaggggagagaaacaaagatacacccagctcttccggagcatggggtgcccttggtggaaataagcaaacattatttttttgccctggggtcagttaaggtcattcaggaatcacttcattgagaaggacagtcttgaagagagtccaagagaaaaagcataaagttatgctttgagtggagggaagggtataatcattccagttaaagggaattgctgtcgatcacagctctgaagcagagagaatgatttgttaaccagggccgtgaacttaggtttacctttgaagttcttaaacactgtataaagctgcatattttaagaagtagagtgagccttaaatatttaaattatttaaatgtgtatctctcttgtagggcatgggaagaggaccatagtttctgtggcctccctaagatggcctgccacctctcctgatgctggtgacttcttgtgatggtggggcaatattaagtgtttgaaaaaggaagaagttcttattcccaagtgagagaccatataaacatagaaattaaagacaagggatttggatgaggtgtggatatgaattacagttttatttcttgctagtcatgtcaccctgggagagttacttcatctttctgagcttcagtttccttatgtaaaggaatggtgacaatattagctcctatcacaaaggatttttgtgagaattcagtgagatgtgccatgtacaatgtttagcacacagtgccagaaatattttatgggagcacagattcaaaaatgactaattagagcagttactgaggcgtctcagtgcaacagctgtgtttattattgaattgcctgcaaaaatgggcacacatggctttttaaaattttttattaaaagttagtaatttatgatggctttattaaaatacatgactagtgtaactggcttttatcacatagaacagtttatgttttcattagtgagacgaaaagaaaaagatttcctgcatcctgaattagagctatcatctgttaaaaatatttatgactaagaaacaaaagatacttgtttttacaagataggagctcaatatataattacaaaatgaatagattcacctatttattaaatacatatttgttttaaataatgataagtgctaatgggggatatgatagggattgggctgtgtgtgtttgtagatattgtagtgttctgaaatttagattgggcactagtcttaatgtctaaattccaaaattacttgaaaattgcaacttctattaagtgtgctcaacctaaaagtttccagaaggtttacgataacattcaagtttaaattcaacataattgcgaaaagttgtattttgtttattttcagagtttatgaactttttctgatgttttcctaatatatgaaaatgaaattgggaaaaaaagttagtttcagtaattggacctacatccttcagcgtggatttgtttccccgtttggctaatgtttcattgacctctacaaggctggcatttctagaataccaaccgagtaaattttagactctccacagttgatttttgttgaagctatcagaaaccatcaagaactcatttgataattataagtttttgtgtttgtatagtagttaatttgcaatcatgtgctgttttgttgaatgtttgaagttggcttgctattgatgtccttttctaggatgcattttccacatagaaaagaatacatgcctgagttctcaggtttatttgttcatttaaaaataatttatcaagtgcctatcatgtgctacatggttctagtattaaattgaaccccatgccactgtgggtattctatcctttttaactcaaaagtcagaaatttgatatagttcaacttattcaaaaacaagtcccctttaaagagctttcaatctaatataaggttttaggtgtataaaaaaagaatgcctctaaaagtttttatacttcattaaaaattttgtggccatggaattctaaaattctgtagatcagaaatatttctatataatgaaatatacaatgaaaatatttcagtataatgaagttatttccctgatgcaaggtctcatttagaagagtttgttttctgcatgaagcatccaaagtaataaatgatttcttcatccttgcgccgtgccgtatcatcaagaattacttatttgtccattttgttgtgatttttaaagctaatttagaatcaaaactgaagtgagaagttgaacagtagcccagttttgttcctgcttggaagaagtaattaatctttaacttcccgtatttctacctactctctttcaaaagcacaaataattttccttaccagaaacctcctaaatttcatagcattcacagtatacactgacatgatgtaggagaggtgacatgttatgtgcttgaattcagagttttttcccccgttctttttgatttaatgcctgaaaagagtagtggcatatggactctgttcttattcaaagcccaattatggtatgattcctggcaaaaacgttcaccattatacaagtccacaaagggctttgaattattgaccctactcagtaaacaagagagctccttgttgttggtcccactggggatgggggagcacaggcaaggtagtggaaggcataaaaaaggaaagcaaggagagatgaatatgcaaaatgctgttattttaaaccctcttgttttagtttacattcaaggaattgtatgtaatggagagggcacagaattaaaaactaaaatgatgggattccaagcaggctaaacttaaagtaccttcctaacgacaagcctacctgcctctgtacccattgtttccccctcccattttggttggaggtgacactccttgccattgggccaatcctcttaccaacatcagaagcccacttctttcttatcatgtttttatcatcctccttctcttctatatcttctccttctctctttctactggattttcctcatcagcatttaaacatatggaagtcttttaatttataaacatctctttatcctattttcccctcctgttaccaccctaatcctttccatctttacctgtgcataagaagtagcacagcaaggcaacacttgtctttactcaacagctccatttccttagctctcattcattaattaatcttcctctgaaagggctaaaccaaagttatcaatcatctccctgaagctaagttcgacaaacattaataagtttcttatcacttaccctcttatcaaagcacaacaaagctgaccatgccactccagtagatcctccactgacttggtttccatgatactagatccgtttggattgtctactgcctcttcagttgctccttctccttcttcatttaccagccagtgctcctcatctgatctgaaacgctggacttcttcaagcttcaatcttcggctctcttttcttctccttagaccaagatttctcaatagcttttgggtcttaaagaatccttgacaaaaaattattgctgaacttccagtatatcagcatgatcagtaagttgcagacataataaactaaaaatactattaatactcttttggagatagaatgatagttttctatggatatgtttattttggctaatattatcagcccactcattttgtgtggttctcctcccactaaggatatcaacttgaatgtaagtcaatagtatgagtagcgcaaactttagtttttctttttttttttaaattaaaatttcttctggatttttaaaaccttatccaattagacttaaaattcttattacaaatgtctactatgtaattagtatgtaatctcaacattttaggaggctgagaaaggaggatcatttgagaccaggagttgaaaaccagcctgctcaacatagtgagaccctgtctctacaaattaaaaaaaaattagccagatatggtagaacttgcttgtagtcccaactacttgggaggctaaggcagaggatcacttaagcctaggaatttggggctgcagtgagctatgattgtgccaccacactccagcctgggtgacagagcaagagtccatctaaaaaaaaaaaaaaaacaaaaaatgaccaaaaacccccccaaacccatacattctactataaaaaatgcaaacacggtatggtatgtggtacatggtgaatggcaagagtgctttttccctatttacaactaaagatgacttgttagctaacctttcttgaaaaaagaaaggcaataagcttagcttgtcttttaaaaatttaattcctttattttcaataattcttaaaacccatgggttaacatagtaaatttctgttaataaataactggcttaagccaaaataatttttaaattgtatttacttagaagcattcaaaatgtcaacaacatggctgcaactgtttttttttttttacaattatagagttgtattcagttatcaaaacaacaattattttgtataaactgcatcagagacaactgaagatgaaagaactaccatctccacatataactaatttgtgcagtgcaccagaaagaacctgtttaaatttccatgccaatttgcaacccccatactgtgccaggtaaggttagtggctattgaaaatactacctggacagggctatctaaagacacattggatagtgtgttaactatataaaaaaagacactgtacaatttaaaaacaaattttatacagacttacatttcaatttgtttctttaaaaagtagtcagttgtgtacaggggggttaaatgcttttaagacaagaaaaacactgcactagaaccaacttattaacattgtcattatctcctcctcctcctccttctcctcttcctcctcctccttcttccttcttcttctccctcttcttcatcttcatcttcttcatctttttttcatcttcctcctcttccttcttgttcttactccctttttttttggctacatcagtctttcctttagcttactgtgcagcaatattctttgggtatttttccttcagccttgcatccttctttttataaggctgcctgtcatctgcagcagtgtcattccatgtctctcccagtttctttgcaacaatggataggctgggatgttctctttcgatttttgggtgatactcagaaaagaatgaggccaaaggaggcctcttgggtgcattggcatctttgaacttcttttttctttcttctttaggagggacatgggtttcatttctcttttgtaacgagtattgtctacctttgccatgtcttcaaatttttctttcttcttggcagacatggtcttccacctatctgggcacttcttagaaaactctgagaaattgaccgaacatttgggtgcttcttcttctgctcctcccagcaagtttacacaaagaatgctgtgaagatattttgcctcttggcttcttaggctctcctttgcccaagtttagttatttttcctcagcaaggcacagaattatccagaatcacccagtgcccatctggttctcacttgccctggcattgtctttatgcagctcaatgaactacaactgagatttacttttttaaaggtaaacttgatagatttaattaaataaaatttgtcagttgaatttaattaatattatttacaacacaaagatttgttgggaatgctgaatagtaaacctcttaaaataataagtcaaagcagtggaaataaaaatacagcttaggacatatataaaagtcaaagtcttacagattgcttgttggaatgtaaaattgtgttgtcactttggaaaacagttctgcaatttctcaaaaattaaatataggttttcatgtgccccaacaatttcaccactaggtatatactcaagagagcaaaaacatacgtttacacaaaagaattgtacatgatgtttatagcagcagtatttataatagccaaaaattacaaatctaattgtttatcaactaataaatgaataaataaaatgtgatatatccataaaaaaaaaagtcaaagtctttagtataaagctgtaacaaatcattttctttgtgagtgacatgattaggctcaaatatagacctagaagttacaaaattgttatgcagatgtgtgttggttttccaatctcttttataggcctaaatatttttaaaagtattatttgaaccaaaaggaaagaatgaaatttacacatgtaatttcaaacttggtttttgctgcaaaaatactcaattctaggtcaaatatatgaagtaagcattcaactacttcattttcaactatgatcagacaatttctgtccttgtttttggtgtttcttaaataagaaaatgttgctcataaatcaaaaaagttgaaaaccacagcaaaatattcactgcttcactgtaaatggcaggatactctgtcttcacagaaacccagaactcatataggggcagaactcttattgtcatttgtaagaataatcagacttcatctcaaagttcttcctcttctctgaaaatcaagttctcatgtgaggagaaaatctagagaaagcatccctcaccaagtcagacacttggattgaagggaaaagtacactcagtgttgctctgcagttctctggatggttttcaatatgctcatatcctccttcaatttcaagcccaagcagcagttgaaacatttcacaatttccttctgtgacttgttttttcctaaagattcaatttctttaaattcaagaatcctgtcatttgaaacaaaaaaaaagtttctgggccatacaaagacttgttcatctggataaggtgatggaaaatggctgctaaatagcctagtttctgcagccattctttatcttgaaaccctctagcaaaatctgacctactaatttcttgaaagtgctacctttcggttcaaacaccctgttgagaactcttcctctgctaactcactggatgtagaataaggtttgttaggtggcctccaatattctcataccatcttcaagccatcttcagtgaactggtctgtgtttaatagtaatcatccttgtagcattactcagatttttttttttcattttgtatttaagagttttcaacaccagtagctctctggaaataagtcagtgtcttgtgatgtcagtgtgaaggtgaattttcttggggcaccatcaacgcagatgccagtgccattcttgcaaaatagactttctgttttcagatataaagatgaagagaaaaagtatcttgtcctttacttgttttgggcaacatcctgcagtagaaaaaaaatgttcttaaatttcaacattatttataaatcttacaagtgctacagcatgatgtttattggtgaaatttgtttattcatcaaaatggacaaagaagctgtaatttttcaatgtattataaaaataccttcagcatcatgtggcatgccatcagtatgtcagcttattatgctgattgagagcgtgactttttcagttgcttgtatggaatctcattctagcattttcctaattatgaccttacctgctatcattattaagttctcaccaactatgcaacttttccttttctaggctacactttgtgctttggataactccaaaataacttgttttcagagccttttccttgagtgtgactgttttttagaacaaaatatttattttgtttgtttgagattcaaattattgtttaaaataatcagtatctttatttgttaaatggctgtaatttgtagttaaatgtcttttcaattttgctagttattgctgcatttttagttgtttggtattgactgtgcacaatagaatagatcaacttggatgtaaaactcattgttaagtagctttcattgtaaaggtgaactttcttttggattctctgcactgggggagtgaattgactcaaaagattttatttccttatccaaccttatcaaaactgtccagaagcctaagcctagaatctttcttttctatctcatacttcatcttcagaaatcatcaacccaatgttcagatatatttgtgaaacacaaatgcagataaaatataaaacagaaaggtacagcagggcacagtggctcacgcctgtaatcccagcactttgggaggccaaggagggcggatcacaaggtcaggaaattgagaccagcctggccaacatggtgaaacccgtctctactgaaaatacaaaaattagctgggtgtggtggcacacacctgtaatcccagctactccggaggctgaggcaggagaattgcttgaacccgggaggggacattgcagtgagctgagatcatgccattgcactccagcatgggcgccagggccatactccacctcaaaaaaatgagacaaaacaaaacataacaacaacaaaaaacaaaacagaaaggcacaatacctgagaaaatctcaagaaatgcaaaacctacaatacagtctatttttaacttaccgaattcacattcagcacttattacaacaacaagcagcagggatcagatgagtcttggtatgtataagtatcttctttagggtgaaaaggtcccactgattgtctgttacacctgtagagcttatttttttccttgtcagtaggttgtatataaagggaggtgggaaaggtaacttggagggagaaggtggacatcattttcctgccttcctcacctttgtgcagcataacactcaacagatatccaaggcctccctcacctggcatcaatatctgagaatggatgtatctaaataaatattgtcctatgtacattaggacaaaatctgatgtttaatatctctgcaatcagtatttcacatggaagctctcgagacatttagcagcccactaggattctgtagaacttctgttgagaaaacttgttgagacaatcttacctacactcatggcttcagttatctaatgctttcaaatttatgtctcctgttggttctggatttaaaattgctgactcgccatctcctcttgaacatttcataggcacatcaaactcagaatgcctaaacttaaattctcaattgtgtctctactccctccccaaccatgcaaaaaagaaaattgtgagccacttccagtgttgttcccctcagcaaatggcaccaatgtccactaactgcacaccccagcaacctggacatcattctttactcatttcccttaactgtacctcctattccatgtttaatcagtctctaattcctgttgattctgtttactaaatgtcacaacattgaatcttattctatatccccaccactctgaatcaaactattcccttttttagggctgaatttccagaagagtctcttaactggtctttgttatctactatgaaaccagtccaagtcattctctactttgttgccaaatcttatcacgtttctccctgcttaaaacttctcaataactaccagcacattgctcttaagatgaagaccaaaatccttaataggacatacagtgatgtgcgtgatcatcccctgctaacctcttctctgccttctcccttcccttattgtattccatccatgaagacttatcaatcccctcttttaagaggctccctcacgctgtcctccctctgtttatacacctcccactcctttcatctcactcttactcatccttcagatctgagtttaaatgtcatttcctcagagaagcaagaagttccttagtactgtgtatttctgcctaatttcacttaccacaattctaattgcacagtttgttggttattatctatccctgaagcaactctgattgctcttgaaaggcagggagtgcatttgctgtgtttaccacctatctccagcattaacacacaataaaaacaattggtgggacaaatgagtaaatgaattattaaattcactaatttgcttctttcatgctattgctctcaagtttaggaataaaattactatactcattacataaaagaaatatgaatttctaattttagggttttttattagttgaactttttactataagcaaaattgcttagcatttgaaatacctttttaaaaaatgttgcctagtctaccatctcatgtatgttgtaagttttatgtgattaaataagttttgatatgcagcaaaataacaacatgaaattgtaaattatactaatagtctgtgacttaattagcatgaaaaatcttcccatttatttataagaccaaataaaaatattaacttgagattagcactgcagctgttgaatatttcagtgctattaaatattggaggacataatttaaaaatgtacaaagatcatacacagatcgttttatagttttatttttcttactattatttagaaaaagacattttgaaatcagtgtttcccacaaagaaaaatacttaaatatgtaattttaatacatgcatatgccaaaattaatatttatttatttttgtttggatataagccaacatagacatgaatgtagctcttttctcctgagatagaagaacacactattgaaattcaatcagagcatccagatgtaaatgagctgttcatctatagcccacaggatgttcactttggcttcaatccttccagactggatccataccaagactttctattattactattaattagcagttctggcaaaattaaggaatattgttatgtcagcttgaaatcctttagactgactagtgatctcaaaaaaagttaagacttgatcgataattattccaagcatgatgattaaaaattaaattcctgatgtgatccatgattttttttccctctctcactctattttagaaaaacagggtaggtatttattagagaggaatctaaaatcagaggtagaaaagggcatggattttaaggtcttctctgtcttcatttagtcttccctttctttccacagattatagatccagactcctgtgcctgaccactgcccatggccaactctctgctgatgactggacttgactacacaagttgttgggtactttgactagaacaccaaccaagtcattggaaatataatgctttgttctttctagctccaagatatgaacatgtgacaacccaaacaaacaaaatcccaacaaggttgtcagatatgcaaattacagttgacccttgaacaacagagagggtagaggtgctgatcactggcacagttgaaaattcaaaagttttgactcccctaaaacttaattactaataacctactgttgactagaagcctactgataatataaacgatttattaacacatattttatatgttatatgtattaggtactgtattataataaagtaagctagagcaaagaaaatgttatggataaaatcataagaaagagaaaagatatttactctccattgaatagaaatggctcatcataaagatcttcattctcaccatcttcaaattgggtaggctgaagaggagcaataagagaaggggttggtcttgccatctcaggtgtggcagagacggaaaacaatccacgtataaatatggacccatgtagttcaaacctgtgttgttcaaaggtcaactgtatttactttaaattacttgtctgacctgagattttcctgaccataatccaagagattgacacctttctaaagtttgttcttatgttttccaaaatgacaacttgttttccagaagttagcagccaccatgttttaagacagaaacagcctgaggttctcccaaggtctattgagcataagagttttttgccttctagtaaaataaacccatattcgcagagtgtctggaccagaaaatcttccacattatcctgtgttcaagtattaggattgtgcaatacatttcttagaagaattctgcctactactcatgcaaacaccaaacaggacaaatacaaaggcgaccacatctagacatgtcatattcaaactgctgaaaactaacaacaaaaaacaaatcttagaaggaaaagaaacctcgcatggggaaacaatgatctaaatgatagccaactttgcaggccagaagacagtgaaatgatacctttgcagtactgaatgaaagacaaagtcaacatagaattctatgtccaataaaaatatcctaaaaaagaaggcaaaataaaaacatttctagtaggcaaaagctgagagcactagtctttggtagatttgtactacacaaaatgccataaggaggttttcaggctgaagaaaaaaataccagttgcaacctaaatgaagcatgaagagtactagaaacagcgaagattaaagactattttaacatctttatttttaatacatatgtacctataaattttaacttcttcaaaaaattgactttttaagatataaataataacaatgtattgagctgcagcatatgtagaagtaaaatgtgggaaaataacagcacaaggaccagaagcatagatacatagaattatatatttaccaggttcttacattgtttgtgaagtaatataatattattttaatgtagattgggataacttaaaggtatatatctttaagatatcatatattctatatatcatatatatctttaagatatcatatattctatactgagcaatctataaaaaacaaagaagcatatctaaaaattcaatggatgagattaaattaaatactaaaaactactctattaacccaaaataagacaagaaaaaagggatgaaatgagagacaaattttgcaaatagaaaatcaatggtaggttataacccaatcatattaataattacactgaatataaatgaactaagcgctcaccccaaaaaaagtgattgtcagataggaaaaaagaaaaacctatctatatgctctttataagaaacatatttaagacagggtgcagtggctcgcgcctgtaatcccagcactttgggaggctgaggcaggcagatcacgaggtcaggagtttgagaccagcctggccaacatagtgaaaccacatctctatgaaaaatacaaaaattagccaggcatggtggtgcacgcctgtggtcccagctacttgggaggctgaggcagaagaatcacttgaacccaggaggcagaggttgcagtgaaccaagatcatgccactgccctccaatctgggcgacacagcgagactccatcttggggaaaaaaaaaaaaaaaagaaatgtatttaaataaagtgacacagtcagatcgaaagcaataggttggggaaaaaaaaccatgaaaaaatgaagtataagaaagctggtgtggttatataaatattagtcaaaggagatgtcaagacaaagattattaccagagatagagaactatatgcatgatgataaatggattgattcatcaagaaaacataacaatcttaactgtgcacctaatgacagagcataaaacaagaggtgatagataggacaaaaggagaaataggcaaattctcatttagttagtgtgatggtttggtttatatgtcaacttggctaagctacagtgcccagttatttaatcaaacaccaatttaggtgttgctttgaagatatgttgtccatgtggtgagatctacaatcagttgactgaaagtaaaggatattacttgatgatgtgggtgtgggttcacctaatcagttgaaaaccctagagtaaaaccaggtttcctggaacagaagatattctgcctcaagattgaagcactggctgggcgccgtggctcacgcctgtaatcccagtactttgggaggccgaggcgggctgatcacgaggtcaggagatcgagaccatcctggctaacatggtgaaaccccgtctctactaaaaatacaaaaaaattagccgggcgtagtggcgggtgcctgtagtcccagctactcgggaggctgaggcaggagaatggcgtgaaccccggggggcggagcttgcagtgagccgagatcgcaccactgcactccagcctgggcgacagagcgagactccgtctcaaaaagaaaaaaaaaaagattgaagcactaacacctacctgagtttccagcctgatggcctatcctattgatttcagactcgacagctcctaaaatcacatgagccaattcctttaaataattgtcttaatacatagatatgtatatcttctattgtgtctgtttctttggagaaccctgacttacatagtgctgttaacatcgctttgtctaagtagacaatataatcagtaaatatagaaaagatttgaacagcattattaaccaagttgatctaattaacaaatgcagatataaattatttcaagtactcatggaacattcataaagatcaacatgtgctgcatcaaaaaacacatctcaacaaatatcaaagattgaagtgatacatagtatattttgtgaccacaacagtattaaagtggaaattagtaataaatgtaagtagaaaatccccaacatttagaaattcagcaatatccttttaaataacccatgtgtcaaatgagaaattatgttggggattagaagattgtttgaactgattgataatagaaaacattataaatgggtgagatgcggctaaagaagtgcttacatggaaagttatagctttacatgcttatgtttaaaaagaagaaaggtttaccatcaatgacctacttctactttaaaaacctagactaaaaacttctctggtttccattgtaacatgtaaggagtttggaagtcattactgcatcctaacaacaaacaaaaagctgaaaagggcctggaaaataaaaacttgtctcagatctatcagagaagtgaggtcacagggcaaactactgtcctaaaaattagagagactgaatacagagaattacaacttaaaggagaagaaacccacaagcagaaacctccacaggaaccagtgctgggctatataaacctaaactctaattgacaaattcttagagccttagtgtagagaaatctaagagttaaaacaccatgggaacccagtcatatgggaacccacacaccttcatgagtttaccattcagagattgaccctattctcccagtagatattgaagaaaaatcctctcatgcttctgtcaggggaagggggaaagtaatcatttaaaagtataccagagcatgccattcttcttaacaaggcctgtcctcaggagaaactatttttaccagagcctaacctattggagtttttcagagcccaactgactgagggaaaggaaatattcaactctaccccactctagccatcctcttctacctaaaaggggagaaaagtgagaagcacatacaaacttcacagtccagaggcacaggctcactaaaacattgagtgctcatcacagtactaaagaaatctaccctgacccacactgtcccaccacatcactaaaggcctatttactgcaattccttttacccagtccatgttcacctttcaacaaagaaattataaagcatacttagaggcaaaatgtgcagtttgaaaaaagtaagcatcagacccagagttggatatagcaggatgttgcagttaccagattaggaattttaaaaaattatgattgatgtgttaaggactctactggacaaaatagagaacatgtaagaatggatgcatgatgtaagcagagtgatggaaattctaagacagaataaaaaagaaatactaaaaaaagaaatgctagagataaataaccctgtaacagaaatgaagaatgactttggtgagctcattagtggactggagatagccgagaaaaaaaactgtgagcttgaggatatgtcagtagaaactttcaaaactgaaaagcaaagagtaaaataccaaaaacaatgaaatggaatatctaagaaatgtgataaaactacaaaaggtgtgaatacatgtaacggaaatatcaagaggagaaagagcaaacagaagcaataattgaagcaataaggacacagttttccccaaattcctgacagatatcaaaccgcagatcccggaagcagagagaataccaagcaggataaatgcaaaaaacaaacaaacaaacaaaaaatacccaaaccaaaaaaaagcctatacctaggcatatcatattcaaattacagaaatcaaagacaaattcttgaaagaagtcataggaaaaaaataccttatctttagagaatcaaaagtaagaattacatccaattttctccaggaatgcatgcaagcatgaagagagtagagtaaattatttatggtgtgtattagttcatttcatgctgctgataaagacacacccaagactgggtaatttataaagaaaaataggtttaattgactcacattctatgtggctagggaggcctcacagtgatggtgggaggcaaaagtcatgtcttacatgcagcagagaagagaaaatgagagccaagtgaaagggtttccccttataaaaccatcagatcttgtgagacttactcactaccatgagaacagtatggggaaaactgtgtccatgattcagttacctcctatagggtccctcccatgacacatggggaattatgacagctacaattgaagatatgagatttgggtggggacacagccaaatcatataattctgcccctggctcatcccaaatctcatgttctcacatttcaaaaccaatcatgcctcctcaatggtcccctaaagtcttaactcatttcagcattaactcaaaagtctcatctgacacaaggcaagtcccttctgcctatgagcctgtaaaatcaaaagtaagttcgttacttcctagatacaatgagggtacaggcattagatagatacacccattccaaatagaagaaataggccaaaatgaaggggccaaaggccccatgcaagtctgaaatccaacaggacagtcaaattttaaagctccaaaatgatctcctttgacttcatgtctcacatccaggtcagactgatgcaagatgtgggttcccatggtctttggaagctctgcccccatagctctacagggtacaggctccctcccagctgctttcacaggttggtgttgagtgtctgtggcttctccaggcacatggtgcaagctgtcagtggatctaccattctggggtctggaggacagtggccctcttctcacagcttccttaagcagtgccccactggggactctgtgggggcttcaaccccacattttccttctgcacttccctagcagaggttcttcatgagggatcatccctgcagggaacttcttcctggacatccaggagtttccatacatcctctaaaatctaaccggaggttcccaaacctcaattcttgacttctgtgcacccgcaggctcaacaccatgtggaagctgccagggcttggggctttcaccctctgaagccacgacctgaaccataccttgaccccttttaaccacggctggaatggctgggacacagggcaccaagtccctaggatgtacacagaagaggggccctgggctccacccgcaaaaccattttttcctcctaagactctagacctatgatgggagggtctgctgcaaaggtctctgacatgccctggagacattttccctattgtcttggtgattaacatttgactcattattacttatgtgaatttttgcagctggcttgaatttctcctcagaaaatgggattttctttcctattgcattgtcagtcctccaaactattccaacttctgtctgttacccaattccaaggtcacttctgcatttttgggtatcttttcaggagcatcccactctactggtaccaatttgctgtattagtctgttctcatgctgctgataaagacatacccaagactgggcaatttataaaagaaagaggtttaatgaacttacagttccatgtgcctggggaagcctcacaatcatggtggaaggcaaggaggagcaagtcacctcttacatggatggcagtaggcaaaagagagagcttgtgcagggaaactccccttataatatggtcagatcttgtgagacttattcactattatgggaacagcacaggaaagacctgcccccattattcaattacctcccaccatatccctcccacaacatatggaattcaagatgagatttgggttgagacacagccaaactatatcagtgcattaaggattgtcatgtctttatggggtattgacccttttatcattttgttatgtccctctttatccctgataactttccttgttccgaaatttgctttgtatggaattacatagctactcctgctttcttttgattggtgttagcataattatcttcactcgttttcttttaatctatatgtgtctttatatttaagatgagttttttgtagacaacaatagtttggccttcttttttgatccactttgatatatatattttaatcagtgtatttagaccattgagttttaaaatgattgtcaatggatctggactcatatctaccatatttgttaatgttttctattcatttaccttgttcttattttgtcttcttttctgtttctgccttttgtggttttaagtgagcattttatatgatttcattttctctcctttcttagcataacacttgtacttctttttgtactttttaaagtgattctcttagtttgtaatatacatttacaactaatccaagtccaatttcaaataacactttaccacttcatattattaccagtactttgtaataaaatattccaaacttctctctcccataccttatattattgttgtcatttattttacttatacataagcatacataagtatcataagcttaaatatatctatatctatacatatgtacccacataagcatacataataaaatatatagattttttaagcaaactactatgttagatcaattaagaataagaaaaaataaaagtttgcattttacttccacttatttcttcttgatgctgtttttctcttttcatagatgagagtttctgaactatatcatcttcttctctctgaagaacttctcttaatgtttttgcaaggcactcctagcaacaaatgcactccatttttgtttgctgagaaagtcttgatttctctttcacattttcttttcttttaattcttcacttttgaaagataatttcacaaggtacagaattataggtggtggtggggtttctcttaacatcatgatatgatttggttgtgtccccacccaaatcttatcttgaattgtagctccatgagcggggctctcatgaagaatctatgctagggcagtgaggaagggaaatgtggggttgaagcccccacacagagttcctcctggggcaccacctagtgtagctgtgagaagagggccaccgtccagaccccagaatggtagatccaccaacggcttgcaccatgtgtctggaaaagccacagacattcaacaccagaccatgaaagcagctgggagggaggctgtaccctgcaaagccacaggggcagagctgcccaagaccatgggaacccacctcttgcatcaatgtgacctagatatgagccatggagtcaaaggagatcattttggagctctaagatttgaccaccccgctggattttggacctgcatggggcctgtagcccctttgttttagcccatttctcccatttggaatggctgtatttacccaatgcttatacctccattgtatctaaaaagtaactaacatgcttttgattttacaggctcataggcagaagggacttgccttgtctcagatgagacattgcactgtggacttctgagttaatactgaagtgagttaagactttgggggactgttgggaaggcattactggttttcaaatgtgaggacatgagatttgggaggggccaagggtggaatgatatggtttggctctgtgtcgccacccaaatctcatcttgaattcccacatgttgtgagagggacccagtgggaggtaattgaatcatgggggcaggtcttccccatgctgttctcgtgatagtgaataagtctcacaagatctgatgatattataaggggagtttccctgcacaagctttctctttttgcctgctgccatccatgtaagatgtgacttgctcctccttgccttctaccatgattgtgaggcttcctcagccgtgtggaactgtaagtccattaaacctctttcttctgtaaattgcccagtctcaggtctgtctttatcagtagtgttagagcagtctaatacgtgcacataaaaacagagtgtcaaaatatgtaagcaaaaactgatacaagtgcaaggagaaatagttaaatccagtattattattggagattttaacacacccctctattagaaatggacaggtccagtaggcaagaagatcagtaacaacagagttgaactcaacaacaccatcaatcaactggttataatggatatctattgactacttcatctaacaacagcagaatacacattcttccaagcttacatggaacattcaccagtatagaacatattctgggccaaaaaacacataccttaacaaatttgaaggaataggaatcatacaatcaatgtcttctctcagactgcaataaaattaaactagaaatcaaaaacaggtagttggaaaatccccacatacttagagattaaacaacatacttctaagtaacacataggtcaaagaagaaatctcaagataaaattttaaatactttgaactaaatgaaaatgaaaacacaacttatgaaaacttgtgggatgcagcaaacatctcacaagtttttaaaatgcgtaaagggaaatatacacagtagtacttcctcatttgcagttttactttttgtggtttcagttatctgtggtcaactacagtctgaaaatattaagtgaaaaattccaaaaataaacaattcttaagttttaaattgaatactgttctgagtagcatgataaaatctcttgccttcccacttcatcccctatgagatgtaaatcctcctttgttcaccttatatacattcactacctggccattagtcatttagtagcagtcttttttttttttgagacagggtctcactctgtcacacaggctggagtgcagtggcactgtcttggcttactgcaacctctacctcctgtgttcaagtaattctcctgcctcagctctgcccccctccccccagccccccaccgtccctgagtagctgggattacaggcaggccaccatgcctggctaactttcgtattttttggcagaggcggggtttcaccatgtgagccaggctggtctcgaatttctggcctcaagtgatctgcctacctcagcctcctggagtgttgggaatacaggcgtgagcagtcttggttattagattgactattgtgatatgaccgtgcttgtgttcaagtaacccttattttacttaatggctccaaagcacaaaagtagaaatgctggcaattcagatatgaaggaagccataaagtacttcctttaagtgaaaaggtgaacattcttgacttaataagaaaagaaaaaaattatatgctgaacttgctaacatctacggtaaaaatgaatcttctatccacgatattgtgaagaaggataaaaaaattcatgctagttttgttgtcacacctcatgctgcaaaagtatggccactgtaagtgcctagttaagatgaaaaaagcgttacattttgtggctggaagacagaaatagaaacatattctgatttacagcatttaggctgggtactatccaaggtttcaggcatccactggaagtcttggaacatagcgcctgtggataaggggaaactactgtagtattgaatgcatatattaggaaagcagaaagatctaaaatcaatcatgcaagcttttaccatagaaaactagagaaagggcaaattaatccaaagtaagcacaagaaacaataaatattagagtagaaattaaagaaattgaaataggaaatcaatagggaaaatttttgaaaccaaaagctgggtctttgaaaagataacaaaactgataagcttctagccaggctaggaaaaagaagggcacaaattactacttttggaaggaggagatttcacttcagagcccatggacattggaaggataataaaggaatactatgaataattctgtgcccacaaatttgataacctaggggaaatagatgaatttcttgaaaaataaaatctgataaaactcacacaagaagaaatagacaatccagataggcctagatctattaaaggaatggaattaataattaataaccttccaaaacagaaaccatgagaccctgatcagttcactagtaaattctaccaaatacttaaggaacaaattatatcaattctctacagtcttttctaaaatatagaggcatatggaatatttactaactcattctatgaggccagcttcaccataatgtcaaaatcagacaaaaacattatgagaaaagatcaatatttcttatgaatatagacacaaaagtcctcaacaaaatattagcagactgaatcaagcaatgtataaaaataattatattccatgactaagtgggatttatcccaggtatgcaaggttggctcaaatttgaaaatcaattactgcaatccatcacatctacagactaaggaagaaaaatgacatggttatatcaagagatgcagaaaaagcatttgtcaaaatacaacacctatttgtaataaaaactcagctagaattttagaggggaactccctcatcctgataaagaacatctacaaaacccctacaactaacataagacttaatggcaagaaactaaaagcttttctactcagatcaggaacaagacaaggatgttccttctcaccacttcttacattttactggaaatcctagctaacacaataagacatgaaaaggaaataaaagatatattgatcgagaagaaataaataaaacagtctttgttcatggataatatgattgtcgaggtaaaaaatctgaagaaatcaacaaaacaattcctggaactgatatgtgattatagcaagattgcaggatacaaggttaatgtacaaaatttaatgtcttttccatatgccagaaatgaaaaagtggaatttgaaattaaagacaaaaatcctttcagattagtgcatccccaaaatgaaatagttaagtacacatccaacaaaatatgtacaagatctatatgaaaaaaaactacataactctgatggaaaaaaaaatcaaggaactaaataaatggagagaaggccaggtgtgatgtctcacatctgtaatcccagcactttgggaggctgaggcaggtgcatcacatgatgtcaggagttcaaggccaacatgaccaacatggcgaaaccccgtctctactgaaaatacaaaaattagctgggcatggtggtgtgcacctgtaatccaagctactcgggaggctgagacacgagaatagcttgaacccgggaggtggaggttgcagtgagtcgagatcgcaccattgcactccagcctgggtgacagagcgagactccatcaaaaaaaaaaaaaaaagagataaattaagagatatttcatgtccatgcaaggaagagtcaatattgttaagatgtcatttcctcccacattgatctacagattcaatgaaattccaattaaaatcctgacaagttattttgcaggtatcaacaaacagattccaaagtttctgtggagaggcaaataacctgaaatagacaacaaaatattgagtgaagttggagtactgacattattcaactaggttacaaatgaaatgggaaaacagtttcatagttggctttgttctatagtttacattagggttaactctaagtgttgtacattctgtgggttttggaaaatgcataatatgctgttttggtgaaaccaaaagcagtaagtgagcaatatatgccttagcaatctatctttattaattcacatatttagagctgacttattcatataaagctttgcttcttataagaaataactggctttctctttaaaataagctgaagctgtgtgagattgtataaaacattatatattgactaatagggaaaaactttcttgtgtatacaggattttgtaattaaggttgaaaatgtaatctttaaacctgaaaggcttaaaaaaatttttagcccccacatgtaaagtgaaaatgtgatgtttgtctttctgtgcctgctttatttcattcagcatgagttccatcatgctcattcatgctgcctcaaatgacaagattttattatttttatgcctaaatattattcaattgtgtatatataccacattttctttatccattcatcctttgatagacagttaggatgattttatatcttggctattgtgaatagtgctccaataaacatgagagtgcaaatatttctttgacatactgatttcatttcctttggacacatacccagtagtggggttgcttgatcatatggtatttctatttggagttttttgaggaaacatcacactgttttttataatggctgtactaatttgcattcttatcaacagtgtaagagttcccttttctttgcatcccacttgcgtttgttattatttgtctttttcatatgaataatagccattttaactggggtgagataatatcttattgtggttttgataggcattttccttatgattagtgatgttgatcgttttttattatacctgttggccatttgtatgtcttcttttgagaaatgttcatccaggtcctttgcccactttttgatcaggtcatttgttttcttgctactgagttgagttccttaaatattttagatatcaaccccatatcagacatatagtttgataatattttctcccattctatagattgtctctttattctgttgattgtttccttctccgtgcagaaaatttttagtttggtataatcccgtttgtctatttttgcttctgttgcctgtgcttttgaggtcttacccaagaaatgcttgcccagaccaatgtcctgaagcctttccccagtgttttttctagtagtttcacagcttcaggtcttacatttaagtctttaatccattttgattttatttttatatattatgagagaaagaaatctgatttcaaatttctgatttcttttgcatttagatatctagttttacagcaccatttattgatgagactgttctttcccttatatattcttggtgcctttgttaaacatgatttggttgtacatgtctggatttacttctgagttctctattctttttcattggtctatgtgtctgtttttgtgtcagtaccatgctgttttggttactatagctttgtagtatattttgaagtcataaagcctatgcaactattatcaatctgggcacatggatggcattcaatatacattttttctttcttaagagtcattcaatcatcaaaatttgggaagtttttggtaaatataggactttaacttttgtgaaagttaaaaaagcaaaagaagatcttcccccaaataagaaaggatctagtgttggagagaacagaaacacagctgaaaatattcatgaaaagatgtggaacgtaagctcagggtcaaccaaggatattaatcagactattaaatgtattctcttctaattagatctgaagtgtgtttaccctgcttaaaaaagtggaccagctgataagtaccaaacaattctggagcgatataaagagaggcatcacccaaagaaggtcatgagttcactggaaaaatgaagtaacactgttgtcatgagtggccacagtaatagccagaagagattgaatgtgccttaagtttaaggataaaaatgtaattgtgatgggaggttggagaggaagctaggcctgtagccaaagtatggaaaaaaaaaaaaaaggaaatacagacaaaggtagcaatagagttgggtgatttaggaagctaggtctgtgaacaaagggaatgtaccaggttcctcccttcatgcggtgcccagggaacactttccagggctcaagtgccctctaaaggcatcactctgccaggttggactcagagccaaatgtaattgtgctgctctcttccattcaagtaggtgcctttgtttaacataagtgaccacttttaaagagctcagtcttcttggttccactcttgaactttcagtgttatcaacaaaaacctgttttgttttcgcattttcccctcagtgccttagcatggtgtcccaaacacttcttgatgatttttaatacttggattatacacataatgcccttctcaatctcccttttacttcccctcaaataaaataaaaaatttaagatactgcattcctgagtccaaggattgttacagttgtcacccccaaaattaggacaataatcacacaaattacaattcttctattcagaacataaatctgatattcttgagctcatttgataaatattaagtatcctcatatggtttctggtttacatacatttgccatgtataatatccataagccattctgggtgtgtgtccctattttataatctctagttgggagggagagcaccaagcctttaaattacgatctcatgcagaataacagctcagggtcaaccaaggataatgatcagaccattaaatatgttctctactgttcggatctgaagtgtgttgaccctcttaaaatagtggaccagatgataagtaccaaacacttctggagggatataaagagaggcatcacccaaagaaggtcatgagttcactagaaaaatgaagtaaaacttattcatttcatgtcagctgctaaaggatgtgctgcagggtgtagggtgtggcttaactgattacccattacggtgatcctaatagttttcatcaatgagaatattgtcaccgaatcttagcatttttgaaatgaaatgttgtggctctattatgtagttctttttgccagtctctgaaatcagttttttaaataacttacctctaaactctcgctctgcatttccttttgtttcctggatgtgaatgtggattcattggtagatgttaggcaaaggctaacttatcagtcatttctaggctcttcaaggtgaagcaatgcccacagacagtcttagaagggaattctgttctctcctttccttatttattcaaagactttcagattgtatttcactattactagagaattctttagtaaagctggatggattcttcaatgcattgggaacattcattcatggaaattggctctattgcagtgtttctcagacttgtgtatgcatacgagtcccctggggatcttgtgaacatgcaggttctatcctgtaggtcatttaatttcactgaatttgtgcaatgcaaaaagtccctttctgaacctgaatccacagataccagcataacctggagcctgttagaaaggcagactttcggatcctactccagatccatagaatcagaatctgcgttttaacaagattccagagggaattcatttgtacaaaatttgggaaacatcatcctgaaaatcacgtaggatcagctatgtaatggcaaaagcaaaagcaaacttatggtaccttctcttttttatgttattctctgattattccctgaggatgcagctgcatataatacggaatcattcatgtaaagagaagcaacctgtccaaaataccttcctttttgtattgaatcttgaaacagtgatgtcatttcctataatataccacatactaacagttgcaaattggtatctgagggctgtgtctagacagaagatatgttttgttggttattttgtttgtcctgtggatgattaaaaggcaatgttattgggcaggtgtgagcagttagcagctattttttcacatggagaagataatacagaggtgttatgcatagtatctataggcatttgagtctggaatccttaagagtaataattcccaacataaattccatggaacagtaatgtaagaatgattaacaggtattatttgaaaaaataaaaaaagtttctgtgatgcgttggcatgataaacagtgaaacaaaagaaatttggggggaggatattacagaggctttatatcataatatgcagtttgaacctccactgcaacatttctcaagcttatttactcaggaaattctgtgtctcaaatgattagagttctatagaacatactttagaacaggagtcagcaaactatagcctgcagactaaatccaacctgccacctgtttttgtactgcctacaagctaagaacagtctttatgtatttacatgtttaaaaccaaaagaagaagaatatttcattacacatgagaattctgtaaaatccaaatatcggtgcttataagtcaagtttttttggaacacaatcacactccttggtttacattttgcctttggcagcgatcatactataagggcagagttggcagctgagacagtgatcacatggcctgtaaagctgaaaatatctattatctgaccctttaaaaaaaagtttgccaacacctactttagagcacactgcgattcgattaccgcaactttttttttttttttttgagacagagtttccgctcttgttgcccaggttggagtgcaatggcacgatctcagctcactgaaacctccacctcccaggttcaagcgattctcctgcctcagcctcctgagtagctggaattacaggcacccgccaccacaccctgcttatttttgtattttcagtagagacgggatttcaccacgttggccaggctggtctcgaactcatgacctcaggtaatccacctgcctcagcctcctaaagtgctgagattacaggcgtgagccaccgtgcctggcctgcaattacttttgcaccaaccaaataaaaaggcctggcttcctcaaatgggaaatgataatgataacatagtgtcttttttgatgagtataagtgtactaacgataacattgtgtagcaaataaatattttctcttgtagacactttgaaatcaatgtaaaatcatatcaaatattcattttactacattataataagaattcctttctggggattaccactgttttcagacttttaagaaatagagtttagatttgataacaaatttttgcaattttcagttattacaacatgtgcctaagtatattttaagctgattaatcttttcaaactttttagtctcaggagccctttacactcttaaaaattattaagggcctcaaagaaattttatttttataggttatatctatcaatatttcagaaattaaaattgagagaatttaaaaaagtattacgcattttaaaataataataaaccattttatataaatatcaataacatatctcttgtgaaaataactatatttttcaaagagtggcatttttgaaaaaatctcattaacatctagtttgataggagatagctaaattctcatattacttctttatttaactgttgtgctattacacctcattaggcccctggaaaactccactcattctttgtgaaagaataaaagtgatctcaaaaaattttttaaaaataaatcgcatcaagtatcttatctgaccacaatgaaaaaaacctagaaataaataataagaggaccatgggacatttggaactgtgcaaatacatgtaaatgaaacaaaaagcacctgtccaaccaatgagtgaaggaagaaattaagaaggaaatgtaaacattccttgaaacaaacgaaaatagaaacacaacataccaaaacctatggggcacagcaaacatagtattaagaggcaagtttatagcaataaatttttacataaaaaagaaagatttcaagtaaacaacctaatgatatacctcaaggaattagaaaagcaagaacaaactaaattcaaaattagcagaaaaaaagaaataatgaagttcagagcataaataaaatcgagactaaccaaatagaaaaaaactcagtgaaacaaaaagttgctttatgaaaagataaacaaaattgacaaactattagctagactaagaaaagagagaagacccaaataaataaatgaaatcagatctgaaaaaaatgacatcacaactgatgccacagaaatacaaacgatcattagaaactattatgaataactatataccactaaatttgaaaagagggagaaaatgaataaatttctggacacatacaacctaccaagattgaaccaagaagacagagaaaacttaaacttacccataatgggtaacaagattgaatccataataaaaagtctcccaataaagacacgcccagaaccagagagcttcaatgctgtctaccaaacttttaaagaacaaataccaattgttctcaaactattccaaaaatttgaagtggagagaattcttccaaactcattctatgaggtcagcataaccatgataccaaaaccagatgaggacacaacaaaacaagaaaactacagaccaatacccctgatgaatatacatgtaaaaatcctcaacaacagactagcaaactgaatcaaacagcacacaaaaatttcaaacaccgtgatgtagtaggatttatcccagggatgcaaggatggttcaacatacacaaatcaataaacatgatccattacaataatagaatgaggaacaaaaaccatatatcatctcattagatgccaaaagagcatttaataaaattcaacatttcttcatgataaaaactctcaataaactaggtaatagaaggaaaatacctcaatacaatcaaggccatatgtgacaaacccatagctaacaacatactggacagggaacaactggaacaagacaagccactcttaccactcttattcagtatagcactagaagtcctagccagaacaattaggcaagagacagaatttaagggcatccagattggaaaggaagaagtcatattgcctgtgtttgcagatgccatgatcttatatatagaaaatcctaaaggctgtaccaaaaaactcttagaattgataaacaaattcagtaaagttgcagggtacaaaatcaacatgtaaaaatcagtagtgtttcacacataaactagctgacaaacaaatgaagagagtaatttcatttccaattgctacaaatacaaattacccaggaacaaatttaaccaaagaggtgaaagatttcacaaggaaaactataaaacacagatgaaagaaattaaagaagtgcactcaaaaaaggaaagacatcccaaatcatcccaaattcatagactggaaaaattaatatgttaaaatgaccatactatccaaagtgatctatatatttaatgcaatccctatcaaaataccaatgatagtcttcaaagaaatagaaaaaaaatcttaacatttgtatggaaccacaaaataccctgaatagccatagcaatcctaagcaaaaataacaaagctgaaggcatcacattaccagacttcaaaatatactataaagctatagtaaccaaagcaacatagtactggcattaaaaacagacacatagaccaatgaaacagaacccagaaccctgaaattaattgacatatacaaagccaactgatttttgacaaaggtgcaaagaacattcattgggaaaaagacactctttcaataaatggtgctggaaaaactggatatccatatgcagaagaataaaatcagatccccgtctctcactatatacaaaaaccaactcaaaatgggttaagagctaaatgtaaaacttgaaactatacaactgctagaagaaaacaggggaaatgcttcaggatgcttgtctgggaaaatattttgtgaataagacctttaaagcacaagggacaaaagcaaaagtaaacaaatggaattgtctcaaactaaaaaccttctgcacagcaaagtaaacaatcaacagagtgaaagagacaaccaacagaatgggagaatattttttcaaactattcatctcacaggagattgaaattcagaatatgcaagaaactcaaagatctcaatggcaaacaaaaaacctccaatcaaaacatgggcaaactatctgaatagataattttcaaaagaagatagacaaatgaccaacacatacatgaaaaagtattcaacatcactaatcatcagggaaacaaaactagaactacgatgagatatcatctcatcccaagtaagatgactgttatcaaaaagacaaaaaatgacaaatgccagccaggatgtggaggaaagggatttcttacacactgttggtgggaatgtaaactagtacagccactacggagaacagtatggaggttcttctaataaatcaaaataggactactatatgattcagcaagcccacaactgggtacttattgaaaggaaagacaattattatattgaaaagacttctgcaccatcatgtttattgtagcactattcacaatagccaagatataaagtcaatccaagtgtccaacaacagatgaataaattaagaaaatgtggtatatacacaatggaatactattcagcctttaaaaagaataaaatcttgtcatgcatggcaacatggctggaactgaaggacatcatattaagtgaaataggccagaaacagaaagttaaacatcacatgatctcatttctatatgggaacaacaaaaaaagttcttggaagtaaaaagtagaagagaggttactagaagctgggaagtgtaggggaaaaggggagatgagaagagatttgttaaagtatacaaaattacagctagaaagaaggaataagttttaatgtttgatagcactgtggaatgactataattaaccataatatatatttagaagtagctagaagagagaatattaaatgtttccaacacaaagaagtgataaatgtttgagatgatggatatgctaattgccctgatctgatcactaaacattgtatatatcaaaacatcaatatgtgccccacgaatatgtacaattcttatgtgtcaattaaaaacataaattaattaaaaaattaaaaaaactagttagtgttgagaaggatgtagaccatatgtaattttcacacattgatggtggaaatacaaaatggaacagttattttggaatacagtttagcagttctttataaagtcaaacatatatttaccatatgccccagtcatccatcttctaggtattcatccaagataaatgaaagcatatttttgtacaacagtttgttccagaagcttcattctagccacaaactggaaacaactcaaatgtcttatagaagataaatggataaacaaactgtggtaaatccatacaatggaatactattcagtaacaaaaaaagaacaaaatactgatacacataacaacatggataaatttcatttctgttaagtgaaagaagccagacgtaaaagatacgtactgtataattcttttatgtgaaattctagaaagcgtgtaagtatagtgagagaaagcaggtctgtggatgctcacagccaggaaagaaggggttacctataaagggcacaaatgaactttggggggtgatggaaatatcctataccttggtcgttgtggtgattgcacagctacatacattgatcaaaactcaccagacgtatacctaaagttggtcaactttagcctatataaattgtacctcagtaaagctgatattaaaaatcaatcacatggctatacagcagtgtgaatgtacttgatgccactgaactgtacaattaaaatgaataaaatggtaagttttatgtcatgtatattttatctcaattaaaatacatggataatatccctccctaaaaatgagagtgaaaaaggcaaataatgtcttagaattgttatgggccctctgaaggtgtgtcaggggcccccagggttccctgtaccacactttgaaaagtgttactcttttgtaactaagaatgaataatcatatacatcacacacacacacacacacacacacacacacacgtgcacactcatacacacgtttatactggtaaaaattatcaacaatcttcaatttaggaatgaagtgtttcaattgtttgcttataagtatcctgtttgcttgttgagcccaattgacttgtactaatagtatttcagaacccatctgtttaggtatttgtgattctgtgtataaatatagagagagtccaacctgggtgacaggaacatgactcccttcttgctgactagtaatggtgctggaacctctatccccgcatcactccttacctgttagtgaaatttgggatttcttcagccccaagctactactggggttcccctggccagggttggaggtaagaacctgatgaaaatagggacttgggatatgagtaggtaggtgtgaaaaacttttcttttatgaaatgcagggattagtgcaacatttttttcaccctcttgcttctgtgttttggatcaagtcctgtcttgttctctcctgtttccccatatcctcctatatttgttagacctcttacaattcaaactagcttacttaaagacaagataatttgttggttcacattccttgaaaagtccaggtataaaaggtagaggagctaacttcagacacgtttagatgtcatcaggacgttttctctctgtgtctctaaactctacttctctgtgttggcatcatttctagttaaactggtcctttccgtgtggtgaaaaataaggctaactgaatgcatagtcatcgtggaaggaaagaaacctgcttttttaccagtgattaaatcagtcccagattaaatgatgccagctggccaaccagggtcacaagccagtttcttagtggaaaaaggaagtccttgactggaaacccctccagaatacatggaaaggtgtaggagaattggagaagggattcaggggagacagcaagggaaaaatttgtcctgcaattcttgtttctaagtgaaatcaaggaccttttgaagttttctgaatgtctttgcaatttttaaattttcattgacaatttgaattaatttgctataataattaattgctttgaaggaaactgagaaatagattccaaactgtagataagatacagacttttagaaatgtcactcttcaactaacctagtattcttcaaccccagctaatcatggctgcatgctccttagcttcatgatcaatgtatgtagctgtctgtttctgtcttgatcatttctgaagctgctgtttccttatgttttctcaacacagaggctaccatgccttttttattgagggggaagctgagacttagtgaagtcaaataatttgtccaaggtctccattagtaagtgacattatagaactgaatccttttcaccccaagctaattttctttccaccataggctctaccttccaattaaacctcttgctagccaaatatgttctaaatttgtttattcattttccaaatatttattgacaggcactcttctggacactgagggaggatacacaatgaagaaaatagacaagttcttgttctcatggtgtgaataccctagcggaagggcagaaaataagcaaataaatatatatgatgtcacatggcaacactactggcaagaagaggattggaaaagtgtgctttttaattaggatgattaaagatgacgtctttgaggttacggttgaccagagccctcattgaagccaggaagcatggcagggagatagtgaaggaagggcatcccagacaggagaactggaggacaaaggctctgggtgtgaaagtctttggcatatttacagggaataggatagaggtggggggacctggaactgttaaggggttggggtggaagcagcaggagattaaatcagagaggtagccagaggaggttttatccagagagaccagagagatggcaaatattcaactgtgtgttctcattctctggaagaagaaaacactttatcattttacagtgcttaccttgagaatatgaaaaaagagaatcttttatcatttcagtcatctataagtgagtattcaaatttatatgttcaatcatttagtagttcattcttacagtcaacatttactaggcacccactgtaccctagatactccgccagatgttagagctatgaaaaaggaaaagagataccattttctatcctccagaaccagatgtgagtatgttgtatacaactggaggatgatcaggttgacaagagcatcttgtattactgtccacacattttttaccccccaaaatgtgtggtttccacaagaactagctggaagcctgccatttactgacacattgctacaaatttttaaattaaatgttttactagaaatggattcaatgtggtaacggatctgtctgactacgtttcagaagggtttaaaagcatttaatttccatgtcacatccattaaaagttaatgatgtcatgcactccagggagcaatccatttcataatttaaagtggaaccaacaaaacacgactcaaaagggaaatgaaggtgacaaggtacagaataacatgaaccagtgtagctgcacctgtcatgacccttcccggggttaacctggcagagaacagagagtttaagggaaatgaatcagagaaccaagccacattccatcttcctcagagagaaaagagcataaatcaggaagaaataaagtttatgtgatatgcagcacacatttttagcgttggtttccttcacactgaaatgaggaaaacagagcataaggaaagccacgtgaggggactgcataatgagctgtgggattccagaggatgtagatctccacgaaccctctgactccacacttgaactgtgaggccaactggcaccctccctccgtctccacactgcctgaggctctttcctgtgcctgcgcttctgaacaacagaggaaacccagggatacgctcttcccaatactcactcccctgcccttccagctccttccaccttgtttacatttgtactcgcgtatttcatgtgggttgtgaaagctggtaacgttatggctacagagtgctctattatattttcaagggcggaaaaaggctgtatgtgaagctgccaaatcaaatccttgccaaaatggtccaagctaatgagaaggtttgtaaattacagttcaatggatgagacgtggaggacaaggaatatcatgcccacccagcaaatagaatcactgagcatcactagcttttttactggtatatatatatatatatattatatatataatatatattatatatataatatatatatcttttttgcactatatatattttgcactatatatatactgcaaaatacatatatacatattttgcactatatatagtgcaaaaaatatatatacatattttgcactatatatatagtgcaaaaaatatatatacatatttttgcatgatcttagtcaaagtattcaaaaatttaagcatttatagagtaaagtttcatcaattcctatacatttaagctggaactagatcgggtgttacttaaactgacaactaatgcaatgttttatataatacagatgatcaataaatttctgcttaatgaaagaataggtgtctacaaaaataaatagacacatttagattgcagaaccaataattaagggcaactttaccatttgagtctacttcctgccccacttcctccccacagtaaagtttagaattttccacatattctgatatgatttaattttaactagtcctatcacttatcagctcatttctagactgattaatggacatcgaccaattttaatttataaattggtcttttccctgtttctttagattttggaagttttgtgtgcatttgctttggagccaaacacgagaagaaattttaaaaatcacagctctttgagtctttaaacatttttcaagttataaagtcatttagtttcagagacttttccattttctagctgaaagcaatcaactttaagaatccctatataagaattcctagaagtgcctggtcagaaaattaaagcagaggaagaattgatttctttgttatagtttccataatcatttaatcagaaacaatacaaaaaattaatccatttcttaaaatgtttacatgacactttctatgcatattcattaaaaagtataaaatatttttgtaatggatcaaaatttaacaaaatttaatttattttattaaactaagttttttctttaataaaaacaatcatgataattaagaaaatagaaagcattcaagttaaaataaagccagtaatattccacactatcaagcttaaaacatcattatgaaaattttgaagacgttaattttagatgtagggaatggtaattgcttgggctttgcctgcacatcagtagcaatgatagtcagatacaaatttagactttaacttaattcctcttttcctgcaggtcctttctcctgtataattatactcaatcattaaaaagaaatgaactcaatatcttaatatacatggaattactctgttgtatctacaagaagcacatttcctattttcaataagttgagttgaaaagaaaagaatgcaactttttgaattattttgtaaaatgcagttagtaaaagctttagtgttgctttttgtctttaatttgttttgttagttgtttctttctgtggtattcactatgatgcattttgtgttgctggaagctagtggtaacaatgcaatagacaaaaatacaggggagtaaagaatgaagggaacagaagaaaaaaaggaactatgagacttttcatgtgacatgttctagagctcagtacagagtactgtggagtttggttttaggtggagttacctctgcctattggagtcaggaatggcatccacataaaaaaaatgtatctgaaaaatgtccaaagcaatctacagattcagtgaaatacctatcaaaatcccaattttctgtttttacagaaaaagaaaaaaacaatttcaaaactcatatgggaccactgatgaccaccaatagctaaagcaatcccaagaaagaaggacaaagttggaggcctcacacttcttgatttcaaattacattacaacgctgcagtaattaagagtatatactatcataaagatggacatactgcccagtggaacagaatggagaacccagaaataaattcacacatatatggtcaactgatctttgacaagggtgccaagaatacacaacggagaaaggcttttctcttcaacaaatggtactgggaaacacacaaaagaatgaaattgtacctttctattatatacaaaatcaaatcaaatatattagaaacttaaacctaagacccaaaactgtaaaactccaagaaaaacatagggaaaaactttatgactttgtcttggcaatgacttcatggatataacacgaaaaacactatcaacaaaaacaaaaacaacatgagactacatcaaactaaaaagctcctgtgcagcaaaggaaacaatcaacggagtgaaaaggcaattgatgaaatgaaagaaatatccatgaaccatctatctgataaaggactaatctccaaaatatataaggaacttctataattcaatagcaaaaaaaccacatgacctgatttaaaaatgagctaaggttttgaatagacatttctccaaagaagatacaaatggccaacaaatataagaaaaaatgctcaatgttacaaatcatttggaaaatgcaaataaaaaccaccatgagattttacttcacacctgtccagatggatatcatcaaaaaaaaaaaaaggacaaaatgtactgatgaggatgtggagaaataggaacgctggcacactgttggtggaaatgcaaaatagtgaagctgctacagaaaatactatgaagattcctcaaaaaattaaaaatagaacttccatatatatgattcagctattccacttctggatatttatcaaaagagttgaaaccaggatcttaaagagatatcagcagcactattcgcaatagtcaagatgcagaaataacctaaatgtccattgacagatgaatagatacagaatatgcgatatatacattgaaatattatcagccttaaaaaggaaggacattctataatatgcaatgacatgatgaacctggaggacatcaagctaagtgaaataagccagtcacagaaagaccaatactgcattattccacttatatgaagtatccaaaatagtcagattcatagaatcaaagaatgaaatggtgtttgccagggaatagcaggaggggggaatagagagttatgaatcaacaggcataaggctccagtcaagcaagatgaatgagctctagagatttgctgtacaacattgtacctagagtcaacaatactgtattgtctgtttaaaatttgttaagcagtaagtctcatgttaagtgtttttaccacaataaaataaaatagtaaaataaaatgtacctgagatgagacttgcagtcctgtgtgagggacaggagtttgcccacagaggagagtgaagatggagagaatgttacagacaggccacagcctgctttgggacctagaagtgagtaaacaggctccctacaggatgtgcagacagctgggcctggggagagagtgccggggatgctctgagggccactgggaggtgaggctgtaaggcaagttgtggcagaccatcacaagcccttcatagacctgcaagagacttccaggtttatggtttgcctaacatgaggggctactgaagagttttgtgcaagacatgtgatgaagtatttgtgacatgataaaatgtcgtttcagccatcttaaaaccactcaaagttgacggtctcctctcctgcctcctgcggcttccattaccatggcagagactgtggtgtctgaggtggtgtagcgtactgaagcaaggctgtcttgaagaagaggagacaactcagtaagtatgttagtcagcataagctaggttatgatgcagtaacaaacaatgcttacatttcagtggcttagcacaacaggagggtatctctcactctttctggatgccctacagaagacagcgggaggtggggtgggtctgttccacagtgtcactcatggaccagactctgccatcttttgactgcactatctccaacacacgacctttttagtcaccacatcaggggagagacaactgcaagggtttgcagtggctcctttatgcttcacaatggaagtaacacatgccatttctttttgtagtcacagccaattccgtagctttgcctaaccacaggaggctggaagacggggtgggggggaagcagatgggtgcttgctgagcactgcagtctctgccatggtaatttcaggtagctagatggaagccacaggaggcaggagaggagaccatcagctttgagtggttttaagatggcagaaacatcaggccacagagactgaggcaatttggtgggggtgagagaggagtggcatagggtgattgctgggtactcactggtggcagcatactcagtgagcaaaactggcagagagtaggtgtagggtagagataaggctcatcttgaccagcactgctatctgcgaagcctaattaaacatgtccacggccggtcgcggtggcttcatgcctgtaatcccagcactttaggaggccaaggcaggcggatcatgaggtcaggagatctagactatcctggctaacacagtaaaaccccgtctgtattaaaattaaaaaattagccaggcgtggtggcatatgcatgtagtcccagctacttgggaggctgaggcaggagaatcacttgaacccaggaggcggaggttgcagtgagctgagatcatgccgctgcactccagcctgggcgacagagcgaggctctgtctcgaaaacaaaacaaaccaaaacaaaaccacaacaacagcaacaacaaaaaccccaaaaacatgtccactaggaactgcaagtcaggagtgcaaaatagagtcaggcctagctattgatatttggacatcatcacccagttataggcagaggttgaaaacatgtaggtgaatgagtctcccaaaggagagaatgtataataagattaggtgagagtttaaaaagttgaattgctcgtgcagtctggatccagagtcatcgcacccagatggattcaagaaatggagggtcagaaggtcagcttccacaagtctataattaactgggttttgatgtatgcttgcagaggctagagacacactgagagatttatcgagtgcaatatttgtttgacatccaaagaaataagacaagccttcttatgaactcttggcagagatttactttagatagcgaagaacagcttgacactacagattattagacaccacaagagtttattaaataaaatgggtggaagcattgattctacatcttaaatatatctctttggtccaggggttgtcaaactgtgtttcttaggggggtctcaggggctgctgcaggatgccaggagctggtgcagagcagagtgactcacgtcttccacctctccctccatcagctctgcggttactggttttatattgtaatgtttcacataagatttcattggagaaaaaattctgcaccacaaaaacaaaaagtttcctttccatctccaatgttaaaaagccttaggctgaggctttcatcatttcctgcttggatcgttgtatttttcttccctgggggtctgtctcgctgcctctgatctcgtccctttgtcatccaccctccgcatggttcccaaagtgatcattctcgaacacaaatccaaatctgatgttggcttctggggcatttttgacttcctatcaccaattgtagaaagttatactctaaagaatggccccaagaaagcatttcatgatttggccttcccttacctttctccagcccccttttcaggatgtccccttttgttccttgtgcctcagccataaacaacaactcatgcctgcagtgcgctgaaggtatagaaggcctttggtttagtgaatccaacttctcagctgcagcttcagcataatgacatcttagaagactccccagcttccagtagtttagttagaagtcctcctctggggctcctgtcatgaagaatgtgtacccctctgacagcacattgcccgcagtcttgtgttaattgatatttagtttatctccctactggataatcagcaattgccttcaggaaacggactggctcatcagctctatctcctcagactttggctctgcacttgaccctctaccatgttgttaaacaagaaatgagtgtcctcctttctggaaatcattaaaataatggttttttatctgctttattcatttgaaaagctttggtctatgaatatagactatacggctccttaagatttttgtctatattatttttgatttttttgttttttaacacctttagaatttcacagcctttataaatataatacttaaaagtaacatttcagagtatttggaaatactttttgactatttaaaacaaaatatgaaacatgaagtatagtaaagatataaaacgataatttagataaaaattctttctttcatggaaaacaccactgcattattcctgtttcaaatgtcctacagcattacatttttttttttttgcagcaactccactacacatttgttcatggtgttcacttcctacaagatacagtcaaaactccttagcctgatttccagagcctctgtaatctgacccaactgactttctcaaccacattacacactaatctttcacagatttttttttgctttatttaaaccttttcccctcatatttctatttattcttcttagcctttggtgaatgctttctatcagaggatttgtaccttcggatttttggaaaagtctgtaccattatatcttagcatattgcttatttgctgtttgtttatttatgtctttggaatttctctgaggcagatactagagcatttatgattcctaacttctgttttatatcctccattcctttatttttgtcctccatgtcacagagatgttctgttccatcttctaactcatcttcaagcatgatttgtcttgtataatccatttgcttagatttctaaagagatttaatgactgtacttacacttgacttttaagagcctgtttcataacttgctgtttttattttacagatgccatttcttcctttatattttaaatactgtaaacatacttattgtcagctctctttcatgttgttctattcttgttggttcctcatgtcctgtaagctgtctttcatgatgctaagtgtcctattttttaaaattctgttttattttgcttacgagtttacttcagaaggaagtatcttttctagagatccggataaccacctggggtggtttccactggtgttcctgtcagcaccttcaagacacactgattctgaattattttttgtgttagtttttcagcctggaattctgagtctattcctactcccacctgttgttcagtcttggggttcttatatctctagaagactcctattttacccacatggtggggctattggctcatttccagcagttatcttgggtatgcaggcagagatgatctggttccttcaaggttagtgcagtgctttctagggttctgattctgcacaggaagcccagttcttattccttctataaacatattttcctggccagcttctggccttgaatagccatgaaaatcccagactttgagacctgtaatctcccttagttccagatacattgtcatgttggctctatgttctagcatttggagatttcctttcttgcttttgtgttctgctatatatttaatatgtaaaaaaatgcttttaatccctatatctaaatgtctggaaatgttgtgttcaattccatcttatcctgttatttcttgactgtctgaatatgtagttcttatttctctcgttctctccattttgaataatctcccaaatgctctctgccttttgcaaattcactcattcttccaggacttgaggagtcactgaaggtaatgcttttttcctccagggaccaaattaacccctaggaagggtcttctatgaactcctttgacatccatttgacacttaatcattttctgttataattattatatggctattatttgttttcttgtgaaattataaaatctttgaaatttggggccatttcttaagcttcttgaatttcttcacctggtctcacaacaaattcttcctaatggaagaaaaacagaaaagaaagacacactaggatagagtaatttaaaatgttttagactttatttacgagggtccaagcacctaggaaaacaggatttgtttaaattttgcttactcattttattcaggattcatgaatttataaggccagagagatttcatataagatcctagattactaaaggaaaactgaaagattttatgtcaagcaatataaaattaatatgacagatgcaaccttagaaaatgtgtttcctgagattcctaaattagctacttttgtgggtgtctgcttagtatttggtcctgagtaaatgaataaacaaacagctacttctgagagctactttcacagggaaatgtttctgagttccagttcatgggagtttaggaaggtatgggatgcaaattacatttcaacactgaaccagccaatcaatccttgaacacttttgaagtctttagctttgcctgtgaacatgggaacacccaagggcaccttcaaattaaaaataaacatacattctaaggagtcctagatgtgtaatttggtagaaatttaaggggtgtctttttatagtaacggagtctataaagaaaatacaattcaggtgaggttacatcctttccagtcataaaagtgtatgtgaatgacatttaactcgaaattcaagtactttgggcatatcattcccgctccctgccccaatcccataatttcttggtagaaactcatagtgcatttttttttcagttccagccagatttttatatctattggatggatattacattaataaaaaaatagctaacacttattgtatgattgtctaatgccaagctatgttcgtataattatctaatatgttggtatgatttgactctgtggctccacccaaatctcacctttaattgtaatcccttatgttatgggaggaacctggtgggaggtgattggattatgggagcggtttccccatgctgttcttgtgatagtcagggagttcttaccagatctgatggttttagaagtggcaatttcccctatgcactctctctctctcctgccaccatgtaagacatgccttgcttctccctccccttctgccatgattgtaagtttcctgaggcctccccagccatgttgaactgtgagtcaattaaacctctttccttcatgaattacccagtctcaggtattctttataactgtgaaaatgggctaatacccagataaccctatggtgttgctgctgttattattcttcccttgcagatggggaaaactgagatgaagagttaattaatttaccaaagtcaaaagagtagtcttaaactactgtgaaatttctgtaggcctccttttttttccttcaaaacctttaatatgctaatacacatttttgtattttttttttaattatactttaagttctgggatacatgtgcagaacatgcaggtttgttacataggcatacacgtgtgattgtggtttgctgcacccatcaacctgtcatctacataagatatttctcttaatgctatccttcccttagccccacaccccactgacaggccccggtgtgtgatgttccactcccagtgtccatgtgttctcattgttcaactcccagttatgagtgagaatatgcaatgtttggttttctgttcctgtgttagtttgctgagaatgatggtttccagcttcatccatgtccctgcaaaggacatgaactcattcttttttatggctgcatagtattccatgatgtatatgtgccacattttctttatccaatctattgttgatgggcatttgggttggttccaagtctttgctattgttaacagtgccacagtaaacatacgtgtgcatgtgtctttatagcagaatgatttataatcctttgggtatatacccagtgatgggattgctgggtcaaatggtatttctagttctagatccttgaggaattgccacactgtcttccacaatggttgaactaatttacactcccaccaacagtgtaaaagcattcctatttctccgcatcctctccagcatcttttgtttcctgactttttaatgatcgccattctaacgggcatgagatggtatctcattgtggtttttatttgcatttctctaatgaccagtgatgatgagctttttgtcatatgtttgttggctgcataaatgtcttcttttgagaagtgtctgttcatatcctttgcccactttttgatgaagttgtttttttccttgtaacattttttaagttatttgtagattctggatattagccctttgtcagatggatagattgcaaaaattttctcccattctgtaggttgcctgttcactctggtgatagtttcttttgctgtgcagaagctctttagtttaattagataccatttgtcaattttggcttttgttgtctttaggcctcctttctattcatgtttctactttagaagacatatatatatatctacatatatatatattttatatatctatatatgccttctaaatatatatgtctacaaatatgtatgtcttctatattttatatatctatatatgccttctaaatatatatgtctacaaatatgtatgtcttctaaagtagaaacatgaatatatgtatctagaaacatatatgtcttcagaagacaaatatatatgtatatgtcttctaaagtgtgtgtatgtgtgtatgtttatatatgcgtgtatatatatatgtgtatatgtatttgtccagagttctcctggggaatctatattttattgagatgagaaggaaacgtggtagtgttggttaacttatcaccacctggttgctgtctaaactcaaccacttcctattgtgtcatggtttgattataaatttcctctaagcctctttttctggacactcgcttatcaccgctaatcctacatacaaaaggttgaatactggccactctgaaagttgacaatctaatatggattaaatgtaaaaataaagctagtgactccaaaacccaccactagctggttcatcacagttgtatatttttacactttctcagtccaccctctaacccaactcatcttcttgtaagcctagcacctattgttggctatctagtggcacactgcaaaggatcttatgtgcctggagccccggtttgcaattttttttttttttttttttttttttttttagagatagtgttgtatacttaaatcttgacaagcaaaagaaaaagaatgaagtttggaaaccatcacttctaaaaagcttgtattttattatttagaacagacttgcttaagggaaagataaaatcaatactttttccccctgttttcaataagtgcctagatattagattttatgtttgtttgttttaaacaacgttttaaacttgagagaattttgggtaagaaaataaataaataagttggatagaaataaaccttttaaaattaaattctcttcactaaagaatgtattactgggaaaggttttaaaaacttcactagaggtccctccaatttttttcacctgtttcctcaagatggggtagtcgaggacaaattgattactgttttaagcttccttccaaatttccattgctgttatttatggttctattccaaatgtaaaatttaggcctttccaatatttgtttttaaaatgaagagactttctgattcctatgaataaaaatactccatgctaatggaaaaatcaagaatcttggtgccaaagtgcttcattcaaactcttagacaataaaataagcaagacattaaattataacaaaggttccaaccttttactaaactagactcaccttgaggagcttataaaagtacagatttctaagttttcccaatctactctttcttcccatcccaagattctgaaattaattggtttggctgagcttgatccaacacattttactaaatatatatgtttattatatatagtctatattataaaataaatataattataacagaataaatataataaatatagtataaagtatatttattatataattatttaaggctgaagatcagtgtccacaaaggcatttcttgctctttgctaatgccagacaaattaatgcaaaagaaatggttggataagaagaaaggaaaatgagaaataatattcctatttataatttctatctattttcacaaaaatcacaagtagctaaaggtagtcattttgcctcaaattgccaatcaggtttaagaagttttttgtctgaatttcctaattctaagtgagagactgaaaatgcaaatgaactatgaccagaccacctatgacaacagaaccctgacccacaatctctgtggccaccagcccaggaagcaaaaccccacttctgtggccttcagcccagagtggtcagggcttggtcaatgactgccagctttccttttttttctttttttttttttttggcttctgcttccaactcaggaccaaggagagaaagccaaatatgttacccttctctaaacaatcacttaggatgccccacttctagttagtgcacttccagcttccctgaagccttcctttttttttttactgtaaaacgttcccattcccatctgtctttgagtctttgtcaaatacaggtgatggtggctgactcacttgctatggcaagctctgaatcaatagcttctgtttgttctcattttggtggtgtttatttagttccacatagctaaaaatggggaaaataaaaatgggaaaaaataaattatccttgtgcatacatgtaaggttatttataccaatttatgcaatttcagaaaatgagaggagaaagcagataccatcaccaaggcaagtgttcaaaagggcaataattacagtgacaagaggaatcccaataacttttattctcagtaaatatggctacacagtcaagagtgttgaggacctgagaatgggaagtcactgctttggctcctgtgattccaccaatacttgcctgaattctcttgaatcaatgaatcaggcgtggaagactagaagcaacaaagagaggagcaggtagtagagggggtaacttttagaaggctgtagagtggtcccttgatatccacagaggattggttccaggaccacccacatatacccaaatccatgcatacttaagtcgtgctattgggactttagaatccaggtatatgaaaagtcaaatgtgtatatgtgtgtgtatatatgtgtatatgtacatacatacatatatgtatatatatacatatacacacacatatgtgtatatatatatacacacacagagactttttccaaacaaaagcagatcaaaaatactgtatatatatatacatatatgtatgtgtatatatgcatacatatatacagtatatacatatatacacatacatatatgtatatatgtatgtgtatatatatgtatgtgtatatatatgtagtatttttgatctgcttttgtttggaaaaagtctgtgaataagtagacctgtgcagttcaaacccatcttattcaagagtcaactgtaatttcaatattttgtaacagtttagtcaccaatattgaagttgagagaaggaagttctctcttgtggacaatatggaatgctctaaaacttgaatccaaatgtacattcttggcatcactcaaataatgtgagcgtgtaacatttatgatatattcaagaggcaaaacccaattctttacactgtagacctgttttgttgttattttagttttgtgaaggcaaggttttaaggcaatttagttctaaaagcattactgagtatttactatttgcaattcactgcacttggtaataaactagagggagatgcagaaactctcttttctccaccaattcttcgaaggaaaaaacatttccattatcattaggtgacaatctacacagctaattgtacatatgaattgactgataatttacagttgcaatatggtgtcataaaaggagtcataaaactttgtgacttcgtttgctttttctctgtaagatatgtgctgcaaatgcaaactaacatcaaataaataactcctgtctttatacatacatgatctaatactttccacaactctgatatttaaggtacttccattatgactagttaattgcataaattcaataattaattatattctaatgatcaagaagaatatttatcaaaaataaaacttgcagacattggggaggaattaaggcatgttaacacattttctatatcaatcaggtacttttagtgtaaatgtgttatcaagtgaactggaacattaaatagaggaatttggtatcattgtgggaaaaataatctaatcacttttcaaacttggctgccctttggagccatttgagaaatttttgagaagcaagatacaggtattctaatttacttggtctgcagtgtggcccttgccaggtgatactaacatgtggcatagagtgagaaccatcattatataatctagaatttagtgtattactccttcaatattatacttctcctccagctcttgggacttttcctgatttcataggttggttgagcagtttttgttattgttgttgtttgtttttttaatgttgacttgttttcccaagtaggtattcttcctggaaagagatagtactcactataaataattaattgacttcctagtcaaattagtccttgatgagtctaaacagtgggtggtagacatatctcatctccccagtttgatcacgccatccgtccttaagataacagacctatagagctagtaggccaaccctagaaacaaaaaaggcaacagttatgtccaggtcattacagcttgtcaatttgcttctcccaaattactgcacttcttgtttcttcattgggttacacgcctgcttattcacgtccctcgatcagtttttcctcaatcctgggtacacaacagcatcacctggggagcattttagatgcctaatgcctaattacatcagtctctgggggtagtacccagttatcagtgttctttaaagctcctcagaagacactgtgaaccattgccttaggctgtagtgctctcaatatttacctaagacattcatgaatctgcattttctttagttgatattacagagctacagaccagctctgacccaagctcatttatataatggcagatagatactattaaaaacctaaaaaaaaatttaatagaagtctttggtaatgtacttacagagcccttgtactttgggccaggggctcttgtaagcactgtacatagattgaattatttattctagccacatcttacagatgagaaaatttcccagtgttacacacttagcgtttgggccaagattcaaatgaggcactctggctccagagtcaccagttaaccacaggtgaccagcaatgtggctgttaaaactactagatgtgatttgataggtgatattcttacacttccattttacaggtaaagaatcaaggtacagagaaagtgtcctaggatcacacagctagtaagtggcagagctgggatttgaactcaaaacagtcccaccctaaagatgatgttctgttaataatctagccttttttttcagacaaatattcaactgacccagctttccataaatttatattactgcagattggaatttggtattgcaagtttcatttgcacttctgaacttattcttcatgttttacccagaaatttattaaaaaaaaaaagaaataaaactggtggatttttcaccctactacaactgactgcactggagaagcaattactacagagatgctacagctgctttcttgatattagtccacggttttaaaatgtttttgatttgtaaatatgttaggcaccacaagtccgtcaagatggtatgtagaaagaagaaaagattctccactccaaatctttatgtgcctgaaaatccctttgatttcccttattagtttggtatgtctttaattttatattaaaaatacagatttcttccagttatgggacattgtcccacttcaaacttttaaaaacaaattaatcagaattttatggtaattgttatgtaaataggacaaatatatctcagccctttggcaagcagccttgacaactgaaacagtttcacactgtggatttcaatcaatgtaacaaagttactgagcacagtctaaaatcaatgaattctagagtgcaggagttttttaaaagtttcttgcttctcgcattttaatataaaaatcatcccaggctattgttaaaatgcaaaaatctgatttgggaggctttaagtgagatgctggacttcatatttcagtaaggtctcaagtgatgtacatgctgctggtctgtgaaccacactttgagtagcaaggacacagtgctggtaaactcgttctccaaaggaggaaaacaaagccttggcttgtagtatttgctaatttccatgatataaatgttcccacaaagaccacattcaagctaccaacgtgatgtcattgaaaatggagttgggaagagacattcagcacgctgcccacaattagctctccaaccaggtacaagccagttccagcacaccactgatctacataagtataagtacatgcaccttcaagatcccacaacatagctgtttcactctgcaaaggatttcaggaggtgagggagaataagaatgtcacaggaaaaaatgacaagattaattacaaagttttcagaataggtgcaaaataatctagttccaaggctatataggctgatgagagggcatgtttaagaagttaaaagacgtgtgtggccaataatggagcctttggggaagatctgaacccggtttggactgtgatgggtttggatgagtgggaaaggagaacacgcacagaaaaggaagtgggataaacactagcaaaatgtctgatgctaaacaaaattgaaggaaaacttggaattcctaaagagttgggagtacagtcattggtccagcagaatgagggcatcctgctttcacaaatgttttattctctggcatgattgaggaataacatattcagattaatcaaacatccaggttaacagagagttgacatatgtaccaaaaagagatgccaatgtttaaagtaatagaatatattagagtacacagaacctaatttctttcttctttgatgaagaaaggactttgagatcttccatgtctcagagccatggctttgagcacctttggtcccttctggtagggttctgtgatggagcctgcaaagttttgtttgcagtgtcctgtaagaagagtgtattttcaagtctttctctagggctgtagaatgagagcatcctaagaaactgactcccttggagagaatttctaactggcagaaatgctctgccttgtagtgcattgagtggttaaaagcccagactcatttccacatctgtaattggggctaataataccaatctcatatggttttggtgattattaaatgaaacttggtcaagaaatattggtgctcaatatttgaatgagcactacaaattagtgcaggcgttgtagccaggcatacaccgttactaatttttaaatcagaattgcttaacagacactgattgtctacaaggccataaacaggatgaggctgtggggagaaagtatggactggtccccaagcctgcagagctaaggtttctgcattctgcacacatctttgaaagaatctatgaccacctgtgcacaatgtttaaatgcctaggaaccttcccttgctacccagggagaggttttccctagaccctctgacagttccctcagtcagcaactatatgaaagaattttcttacatttctgaaatctgaatagaggtttatttgggaaaaaatccttttccctcctgtctcttggaataaatgtactatttcgttttcttaatttgtactatgttaagaaccagtagagggaacttaaggtcaatctgtctctcaggttgagtaactctaagctataagctccagaatcttgtctttgtctctaattccaaatgggcttgtggggaaaagtgatataaccatgagatcactgtgttcttttagatgatttcctgtttcctgtgtatttaaatacacagggaataatcccgctattaaaatgagaccctgtatgtgtgtatgggcagaagttcaatgaaaaaggaagaaaaatatgcttgctgaataccagatgtagaatgcataaatcctgtcagaacaagtggggaatagcttttatggctgacttgcaagaaacctaagggaattgggaaatcagataggcatgtgtcaagcagacttatttaaatcatccacttcctcagcaaaataaaagtttgagagggttctgcttccttttgtggtttgaaattacagttgtaggcctcagaagtcctgcttgattgagggcttccaagcaaagacgttatacaacctagttcaggcgcccgacaacactggggtcacccaatgcctctccctgaggtctccaaccttgccttgtttgtactttgtgtcctttgtcatctcagaagcaaattgtagtgcagctgaccactgcttcatggacctccagcttgtccctactaaaaggcttttgcatctgaaagagaaagatgcccactggcttccttcttagaccactgctgtagatcctgagcacaaaccttagctctgcaggcttggagaccaggcaatgctttctccttgcagcctcattctgttcacagttcgcacagggtttatggccttatagacaatcagtctgtggtaagcaattctgatttaaaaactaataatctgtgtatgcttggctacaaggcccacatgaattcgtagtgagagataaactagataccaattatttccaggtataatatcctaacaggtaagtttttcaggaggccacattgtagttcagcaggttactggtgtgtatagatacaaagcaaaggtatttaagtacaaaccatttcctttaaggtgtggtagctccctaaattgttcttctcaggatatttctgttttaaaatgtcctgttaaatatattatttttatgtacagtataattttttaaaagcatgctgacatgggaaaatcatggactttgcagacccaggtttaagtcattccaaatctaccacttactgatgtgtgaacttcagcacgttactgtacctctttcagactcatttccttatcttcttgctgagaatgtgtgtgtaaaaatattaatatggaatctagcatggtgtctagccctttgtgaaaccctgacaaattcttattcctcaccattcatctgttcatctgtattagtttgttttcacggtgctgataaagacatatccgaaactgggaacaaaaaaaggtttaattggacttacagttccacatggctggggaggcctcagaatcatgatgggaggcaaaaggcaccttttttttttttttatggagtttcactctgtcacccaggctggagtgcagtggcacgatcttggctcactgcaacctctgcctccagggttcaagcaattcccttgcctcagtctcccaagtagctgggattacaggttcctgcctccatgcctggttaatttttgtatttttagtagagacagggtttcgccatgttggccagactggtctcgaactcctcacctcaggtgatccactcacctcggcctcccaaagtgctgggattacaggcatgtacaagtatgcccagccccaaaaggcacttcttacatggcagcaacaagcgaaaaatgaggaagaagcaaaagcaaaaacccctgataagcccatctgatcttatgagacttattcatgaccacaagaacactatgggggaaactgcccccatgattcagttatctcccaccaggtccctcccacaacacgtgggaattatgggagtacaattcaagaggagatttgggtggggacacacagtcaaaccgtatcactacccatccatccatccattcatttattccttcactaaatgcctgttgaacaccttttatgtgccaaccactgtcagttagtggaggcacagacaaaagtgagaggtgaactcagttgatggtatgtaggtgggtctatttctgggctctctatgcttctccattgatttatttgtttatttttttctctttgtttgccaaagactttcttaatctttaacaatgtaattccagtgagagaaaaagaagtttcagaagtaatataccaaatcatgggatgggactgtgggggtggtgagtgagttcaggagagtgagtgagttcaggagagagagagagagagagagagagagagagagagagaaaatgaaggccatataaggtaaagtgttgaatgttacgtgctctgttgactgtgggccccaggatgtgtatgatggaatttactgaaacagaatttgcacatttataaaaaggatgcagttttagaaaatagctagttatgctagcatcttgtttcttcattgatgctgcaatgttatataagcactgaatcctcccacatttccagctcttatctaaaagccagaatgtgtaccacctgggttgagaggaagatgaaatgaaattggggaagtaaatggtaaaaagcatcctgaaagaaaccaactagatatgttcaagtcagcaggttatttagtattttgagttatttagtaatttgagtaatgtgtaaggggtgtactgacatgctttttctctcattttctccctgttctgcctgtagcaattctaccacctttgttgacctcttcttccccccaacttattgctgtagaggctacctgagctcattgtccctggagatggaccaaatagaagaataagcagtgcctgtgtggtgagcttcaagaggcatctgttctctggggagtgggtgggtggtaaagcaaagacgggagatgtgtatattagctatccattactgtataattaattatacacaaaactaaactatacactaaactaaaacttcacagcttaaaacaggaaatatgtattatctcacacaatttctgagagtcaggaatctgaaaatggcttagctagtttggttctggctcagggtgacctatggagttgcagccaagatgtcatctgggactactatcattggaaggctcagctggggctggaggctacacttccaagatggctcacttatagggctattggtgggaggcttcagttcctctccacatgaaactttcctcatgccatggaactggcttccctcagagtgaaagacccaagagagagactaagacagaagctgcaatgtttttatgacctagtcttggaagtgacttactgtcatttctactgtattttattcattagaagcaagtcattaagtccagcccacattcaaagtaagaggatttaagctgaacctcttgaaaaaatggtatcaaagtatttacggacattttaaaaactaccacaatacatataggtgaacttcacaaggtgtagacatgggctgagacagaatattggataatatctcattctgcaaacagcagcctcatctgtaataaaatcccagcattcagaaattatcacgatcaagtaggaaaagggcttgttggaaaaaacttatcaaagatgttacttcatttatccatttattctgagccatagcataatagcgacaaattgtgtgtcctgtgtaatttggatacctctgctcaataatagctgaacagattttatcctatttttagaatagttaatatatacacatggcacaaaatttaaaaggtataaaagtttctggttcaaaaataagattccctcattttctttttttctgattctttgaatgcaattcgatttactgatttctcatgtagccttagaaagtattctatgtacttacaaacatatatgtacacatattttttctttcccacaaataaaatactgtatgcattgttttattcttggctttttttcaatggacagtatatcttcaaggacttctacaatagcacatatagacctgctttatctttttttaaatgtctgtctagtactgcattatatttatttaagcagtcatctattgacagacgacattaggttgtttccagtctcttgttactatggacaaagctgcaatgactatctctgcacattcatcatttctcacacaggagtagaattcttcttcatttgtaacattgacagatattgacaaatttctctccaaaagggcttaccattttgctctcactacaatatgaatgcctgtttcttcaacccttggcagtacaataggttacccactttttgatatttgccaattaggtaggcacaaatggtctgcagttgcagttttaatttttattatctttatgaatgaggttgggcctccttttatatgcttaaaatcatctgcatttgctttactatgaattatttgttcttaatctttacccgtctttatattgagttggtgggtttttattttccttactgatgagtgggagttccttaggattaaagaaattagctcttctaaagaatcggtatacatggacagacagagtggaataataaacattggagactctgaaaggtagggataaaatactgcctactgggtacaatgtacgctatttgggtgatgggtatgctaaaaccctagacatcacctctatgcaatacatctatgtaagaaaactgcacttgtacctccaaatctatttctttttaaaagaaattagctcttcatctagagtgtgagtggcacgtattttttcaagtgtgttttttccatttgttttttgactttttattggttttctttttctttttccatgtagtaattttaaaaaatatttttctgtggtcacatttatcagtttttttctcttatagtttctgggtttgcatcattcttagaaagtcttcccactcctagggttactaagaatcctcttaaggtttcttttagtaccatcataatttgatttttacatttcaaatttgactgaattggttcttttaatgctttacactctaccgaagtataaaatactgcactgaccatgtttgttttgtttctggttcagatatttctagtttattctcagttttcttcgtttgtgaaatagagataataagtattactgagtaccatccatgacttttagtggagagatgccatcttgatgactgaaagctaaaccagagttttcttcctcattctcattacttagaaacctttgctgatgattaggtttggtgccctaatgggacaattgagactaacacggtctataagataacttgcttcaatttaaaaaggcaaaatcaaattagccatttcatatctgcctacataggggctactgctttcatttgtaatgtttaattacatttttttccccaagaatacatacacacggctatcacttctaaaataattttggctccctatgaagcagaattggaaagtgtcttaaagttagttttgaattggttatttggaattcaaaatgatacttcattaaaacaataccttaaatattggttaggttcttgagccttattacaaattccatacttatgtatttatgattcagaataggaggaatggtgctatgtcaatgacatgtaatgatatttaataacagtgtgtccctgttaatatgtgtctgagtggcatatcaggaatcccaaatatgtcttccccagtccttcccgtgcatcctagcagcagatgtgagaaccccaatagcccactgggaactggttgcaaggccagaaaggacactctggtcaggagaatacctctttatattagtaccagggaaagctgttttctaatatttggcagttgtcctgaataggataactagagaaattaggtctgtggtgtagaatttcagaggcgtatcatattttttcttggcaaataatatggttttgctgtatccccacccaaatctcatcttgaattgtagctcccacaattctcacgtgttgtgggagggacctggtgggaggtaattgaataatgggaatgggtctttcctgtgctattctcatgatagtgaataagtctcacaagatctgatggttttataaggggaagttcccctgcacacactgtctcttgcctgctgccatgtaatacgtcccttgcccttccgccatgattgtgaggcctccccagccatgtgcaaccgtgagtcaattaaacctcttttctttataaatcacccagtcttgggtatgtctttattagcagtgtgagagcagactaatacagcaaacaattagctttagggaagctggcaagcatgaaatagcgtcttagccatcaaggtgggttttaagggaagggaggtcctggagaagagaaggcagaaggcagatccccaagacaaggattcagccatacacagaaagaagatagcaatgtaggtgtctggcatgggaagcaaggtgggaattgaggctcgagaataagaaaaaatctagatatcaggactaaagtctaagactacctagaagagtgaaattatgctgagccccacactgatggtttggagataattcatctccagtgtttaaggtagggacctgggaactgggccaaagcatgggtgaaaggtgagaatgaagcgggtctgactgtggggcaaggagaggacagtggctgattatgggacagggaagatgtttaccacctctgagtggaagtttatcaccaccgagaaagtggatgaccattatttggtgaactacttatactgctgtattttgtgtatagtactaaatatatatatatatttgtttcaggattatttaatggttttgcccatgtggaaagaggcatatgcttattctatttctcaatgacatttatgagtgctataattataataacaatgatgaaagtttgactaatcaatatgtaaatagtacttatagtgagccaaatctattagaaagccagccagtctaaaagagaataaagttcccatattgcaaatacaaattatgatagtttggaataaaaatcaaattatattttgctctgtgatgcattgtgcatgctatctatgttctttgcgtctccttccatctgtcttcccgctgtttccctgctcattaacacctctactagaaagtgggcagggtgatgacaagaaataaaaatacaagttgaactgcaactaagaatttaacatttaaaaaatgccaacgtaagaatgatataaatatctcaattgtgaaaatagactgcgaccctggttagtatatggtattttaaatatgtgaaaaatgtgaggaattggagcacatcccataaaaaagaacaagttcacagaatgttatcaagggaaaggactgcagagatagactgcaggagcatctttccatacaggtgggaaatgcagaaaaattcattaaaaaaaaaaaaacgaattagcaagtacgcgtaaactctgaagacctaaacacatttctggaagctaactgcaaagcttggcctaaacatggaaatgctgaggtcacttgctggagtcaggtacggcatctgcaatggaaagatttttttttttttaaagaaggttatttcaacattttcaaaaaggaggctggggtggaaatatatgacactaggtaaatatacatcaaaatatttatatcataataggcatgtagtttatttaggctacttttattatgtttatactttacatctcaagatttctacaatgaacatgtatcaattttattatgggaaagtgggctttaaataaaaaatttatgttctgctctcatttgcttatctgtcagtggagtttcttcagtgaattttactagtcaacccgtttttacaatgggattgagacagggatcaatgctgggaatttctgacatgcaaatgattttaatgatgaaagcatggagtttagtcccaatgaggtcatgtatgcatgctgattagatttatcagactgcttctaagcaggaaggacttttaaaatttaaagattgagcgacccaacttataggaaattcagtggctcaaactatattttccaagtggtgtgataagataattagacacaattaacttgcagctagaagacaattaccaccacaaaatgttaattgtttgttctagaaattcctgcattcagtctcaaattagaagtatgtattaatatatataatattatacaaatatattattcattacatattacatgtaaaagctaattgagtattacacatattatttattagtgaatctccctgagcttcaaggaaattatagacttcaaaaaatttttgtggcctttggtacaaatgaagccgattttagaatttcacagattcttttatgaggataaataagtttttgtttatatttttgtggtacaaacctaataaagtgcccaaatcatcggcctaaacatggaacttatttcaagatgtattgattgatttaataacacaaagttgctgaagtttttaagatatattatctgaaaccaactggaaatttctgattatatttccaaatctgggcaaactttggtgaaccctatgtctgtgaaaatgcacacttgcttatgaatctgataagctttattctgagatccactgtgagtaatgcaaaactgaattcagaattgaggatgtcctgagtttaccccagaattcaccaaaatattctaatttgttaaatacaaaaactctcattgaaatggatgaaaatgatcatgattagcattaaagccgtaagtgtagattaagtagctttctgtttaatgcttctaaatagaatgcttctaatggtacacccatgttattttctattaagatatattccactcatgtttatcaataaaagctatatgtatcacacacatactgatttctgaaaattgaagtttatacaagtaaagtaattttttcaaagttacagcatggctggctagaacctaggtatgcaaaatcatacataatcagtggtcattctacgaaacaatgctacttctccctgtcgttagagaactaggagggacctttgaaggaatttgataggaactgaaagtattgtcatgtataattataagaaagaaaggttaaagtgtttcccaaaataatttttactttataaatgattgattacaaaaagattagaagataagattaattaggtttgtatgcctcttttacaatttattacttgtcattgtacaagttttaaaatttctgccttttgcttttcatttttaaaatggggataataactgtgcctgtatcacatggttgtattggtgactatgatttaataatataaaaggcttggacaatgcaatatatcagtgtagcaaaatttcatttataccccatgattatatacaaataaaaaagagaaaaataacaataataaaattaaaataaaataaaaaatagctttgcagtgaaaaataataatataaaaagcttgggacagtgtttgacacatcataagtgttcaaaaaacattagatgttattatcactatatgtcaagcactatgttttgcccttagtatacataattttaatcattccttacaacagcagtgggaggataaatattatcattcccacatggcagttttcgtaagtgaccatttttgcatggctaatatgattaaaagtcaacattcatacccagatctgtgtaagtctagaacagcaagttggtaaattaaaaactattttacattttcaaagagttgttaaaaaaatgggacagagaccatctgtagcctgcaatgcctgtaatacttactgtctgaacctttagagaacatgtttgctgactgccactctagtgcagttttttcttctgtaatatcagactaggctgcctcctgaaaaccagatgcctattttaattgataaaatcattcatgttttcatttatttgacagatatttattgagtacttgatatttgtgaggcgtgtgtcaaagtttgttcaggctgctctaacaagataccttagactaggtaatttacaaacaacggaaatttattgctcacagttctggagcccagtaagtctaagatcaaggcagcagcagatttggtgtcgggagagggttcattctctacttcatagatggtatcttcttgctgcaccctaacatagtaaaggacaaacaaacttctttgtcctctttcataaaggtactagccccatgaccgaatcacctcccaaaggccccacctcttaaaactattgccttgggaattaggtttcaacatacaattttttttgttgttgggttgggggatacaaaatttagatcatcacggcattttctagacctgtgggtaccaggtctaggaaaatgagtgagataataacatttccatcaagaaagttgcaatcctgtgaggaagtctaagagaaaatagacaatcatgggacagggtgaaaggtattttggttcaatatcacaggcttctgtggaaacacataggagggactttgaatgtagcattaaggagtcagatataccttcctggtggaactgatacttgaaataagtccgaatttttagtttaagagtaggtatagagtattctaaattactggagaagcaaataagtacaatgcaaaaagaagtatgagaatctgaaacgtagttgaagtttatggtaatggtggaacttaggaggagggtccctgttaaaagagagggtgagaaagaaagagtgcaaagtataaatatcatgcatgtcgtgctactgtttaaaatttatcctgaaggctatgaacattgtcacactgtgggattattggaaactttcagcagggaagtgacacactaaaatttacattttcgaatgatccttctggaagcatgggagatgaagaacaaggattcaagagtgaggacagggcttgcagccatggagttaaagggcctggatttaccctcatgtcttgatcaactctaacattacatgaagaagacttctcctcagacattggacaataggcagcacaagaaggactgtgaatctcgggggaagagaagtaagtgaggtgagccctgcactgcaattgcctaggattttcgcctggaggcacattttagactgcagagcagagagggagattccaagcaaggaaaagttgtcttatataattgaggaggcagaacttgaagtttaggaagtctggtgtctgtaaatggtgaggcagagatctacagagtagggagctacacagaaaacgggcttgagaaatatacacagtgggtcccatgagtctgaaaaatatcaagacaatgcacagcgtgaaatgctacaaggctgggcaaagaacaactgtggagttatgagaggagcgtatttccacaatacacacagactgcggaatcatttgcattaccaccagatagcatggagagccctcattgagcctctttacttggagaatgcagtaaagactccatccagaaggactactctgcagtagtgggctaacccattcctagaggaaaggtttctctagccctgcccaagcacaacttaaaagcaagtctcaaaaccatctaactaaatacttatattagaaaagaagtagtatcaacaatcaatgatctaaatttattagagtctaaattcccaccacaagaggctggaaaagagaagaaaagttaaaccaaagtaagcagaaggaagagaataaaaatgataacaaaaatagaaaacccaagacaaactgagaaaatttatgaaaccccaagctgggtttttgacaacatcagtaatattggtaaatatctagcaaaactgatacaggaaaaaaagggaagacaaaaaattatcagtcaagaattaaagaggggacatcattaactatcctatagattttacccagataataagggaatattagtaacaaatttataatgacaaagttggattgttgggaaaagcatcctgtggtagcagtaagtagccatccaacaaaagccactataacaataacaaaaacacatcattcattaaccaattttatgtggcaggtcctggttaaagacagtggaaagaaaccaaaaccaactaaagaagaaaagcaaggattatttattcagtgtttgctatagcaaggggagtctgccactgtcacttgtgttttgggagagaatcaaaggcaagcagaggagtgggaagcttcatagtgagaaataaagggaaggcttcaatcataccctgactggaggctgttgtcttggggaagttggaggtaggctaaccagaagcagaacatcctctgtgattgcttaggggtgcatatttggctttctctggtttgtcctaagtttggagtggggacagatattgggaaagctgtcagttatgaatcaagtcctggccattttgagccgattgttacagaagtttttgcttagcttcctatattgtttctacagatagcagcctgacttatagcaggctggcttcctggactatttattgaagttaacagattggctttctggacaagattctggaggttgatggtcaaagttctatttttatacatggattagttcatgtcagtttgtatattcagtccctcagtaataaatgatatagtgatacccaattcattctgaaagcataatgaaaagagtgacccagtcttcctgggagcatccgagaagcctttacagtgaagctaatatttgaagttgccttaaattctgaggcaaaaagaagatgagaagaaattgctaccagagatgaccacattaaaaaaaataataagcaggtgggtgggtggtgtgtttgaagattagtgaccttttaaagaagcttgaacataggcgggtggaggcagacagccaggaaagaaaggtggaaccaaaatgtaatggactttgagtgttgttctaagatgtaatcttatgggctccaagggagacaggatgctttaaagccaatagttataatattagacttgtattttaggaacatgatccttttgatagtggaaaatatgcatggggtgggtcaggaaactggaaacttgcacacaagctaggatggtattttaccaattggaggaagtggtgggaaaggccttgatttgggcagggacggtggggatacagcaaagggcagatagaacaaccagggcaacattttggacatgcagtgcgtgctccgtaaatatctgttatatttttaagtgaataaatgggacatttaggaagtggaatgggttaggtttggtgactgattggatattataaggacaggaaatagtcaagaactactaaagtttttagcttcagtgactgattgtatagcaatgctatcagccaaagtgtgaaaaataggggtgtggcagtttatgagtgaggatgccaagtttcatttggggcatgtctttagggcttataaaattggaatcagggtttgggggggtcactgatggcacataggtaatagctggaattatgcaaagaggtgggattggtcagaaagactttccaaagctaggggagagggtccagtccttgaatgcactgattctcactttttaaaattatttatttattttttttgagccagagtctcaccctgttgcccaggctggagtgtagtggtatgatttcggctcactgcaacctctgcctcccaggttcaagcaattctcatgcctcagcctcctgagtagatgggactatgggcacatgcccaactaatttttgtatttttagtagagatggggtttggccctgttggacaggttggtctcgaattcctgacctcaagtgatccacatgcctcagcctctcaaagtgctaggtttacaggcatgagccaccatgccagcctgcactgatttttaaacagtggataaaagaggaagaaacagtgtttgccattaaatactgttgtgtgctacttctttggaatttttcctttagtttcttgcacacagtttaaccattcatctacttgtatgtagggagatgaaacagaataccttttaaggaaaactatggaaatcacattgggtggaatgtacagaattcggagactctgactctttgagtcctgagctttgcgtgagggtgaatgacctgttgcacaaagggacctgagttaaaatccaagctcacctaatttctgtgaccttggccacattacttttctcagttatacactgaggttaatgatatctattttaaagagtttttaggattaaatgagataattctacataatatatgtaaagtgcccactggtgtcttgcatgtagtttgtgctcaataaatataagttgttattatttttgaagacctagaagaatgacactcaagaaaagccatcaatgcaatttttttaaataaaataaaattatggtattatttttgttgtttatattgcaaagttgatcatgtgaatttcacatttctctcttttaattctcccctacctaagaaaaaacaaaatcaattttttttctagagagggattttgaaaaagtttcaaaatagcattttcaaaatagcattttattatttctttggttcaacacgtgtttatccttatctaaaattaccctgaagattatttcctaatatggaataaatgcttctaggttacaagcatttattgggtgccttaccatgcatcagttactgtgctcaatgccagaatacaaagatgagtcaggagacttctcttgagaaattcattcattcatttactcaattaattatttatgtaactccttctaaagggcaagtgcttatctcagtggtaaaggtagagcagggatagaataaatgcacaaaaagactcggagctttggcagactgtattaaagtgaagggagacatgagagaaaataataaacaggtaaatcgagaaggtaagtttagatgttgcttagtggaaaaaaagtgaaaagaaataataggtagagattgattggaagagaacagcatgtgtggccagatggcctctggggattggggtaggattggggaggaggatgagagaaatgagtcaaaataattattataaaacaaaaatattgcataattgggagcaaaggaaattatagacatcacgcacacaaaaaaaaacagcccaaggaggaaaaagctataaatgcttaaaatatattaatttggaatcacattttaatcattttagaggttttatatgctcatgactcccactttaacctcattcttgaactaatgataatacttaaggtagggggaaaaaaagatctctttctctgttctcccaaatactcactttgggtaaacatcctgattgcaaattaacctcagtcatgttggatagaatttttgttataagtaagatttttgtgttggtcattctcccaaccaagtagatcttcattatctgtatccttgaagttctagctacggtctttaaattatccaaccagcatgtagaatcaaagtgatactgaaagtcataagactttgaaactagaaaggaccattttgtctaattcatccttaattcgcagcaggtggaatggaggctcagaaataaataacagagagtgaaaaacagtaattggcagagcaagaacagaaaccctggtttcatatcaccagattcattgattgagatctttccagtcttcccatctattcaagaaactagcacttcctaaatgccaggcactgtaaagctctgggttcctggatgagtaataagtttctctgcaagaaaacactctctcattccctagaacattgtagagtactaaaagatgtctcaattaagcaaatgataattcataacctctcaaagtacaatagacattattgaaaatgtctaattgtcacttgagagcaaatcttcgacatgcttattctttacccttttgcatcaagagttttaaaaatgatatttcaatggagaaggctttggaatgatagatttggagcttaatctagactgagacttaccaccttttgacctaggaaaagttgttgagcttcactttctagtggcaaaatgtgaccaaagttaccagcccaatgccagggactcatagaacttggtgtgttgatggaactgtccttcagttgcactgcttgaggttaggaggctgcaggaggttgggctgagaaggcccttgggcccacagtcttcaaaccccagtacacccagctcttctctacttccccaaagctctcagggccctttgcaaacaagaactcatgcaggacagtgaactctgccctacatccaagggagaaacctgaacttgggagttggaggttgcaatgaacactacatcaccggccactcctactcagcctctgtgattagttcttctcatctctgatctctgaatgctgtcatgttccagggctcaatctctgtagtgcttttcttttctgtctacattaccctttgtcatatcatccagccttctgattttaaatgccatctatacataattctgatgtatatattaactctagagttggaagtctcaactcatatttgactacctcctcttggttgtctaatagtcaattcaaaattagtaaatccagatcgagctcctgatttccctcaccaaacttcctcctgggtggtctttcccaactcactaacatggcaactccacttgttttttcagttgctaaggtcaaaaactgtattcttgatttctttttcttacatccaacattcaacctatcaggaatcttgttggttctatcttcaaaatatgttgaaacctatcttttaaccactttcaccactaagagtctggttcagcccccatcatctcctgcccagatgacgcaagagcagcggtctcagtttcagtgctcagtccctctgtttctgtattttccctcttactgtctactttcaaaagcggccagagtgatcagagtgaaatggaaatcagatgttcctcttctgcccaaagttctctactggttttctatctcactcagtgaaagccagagttcttagaatgatcccaaatgattaacagggtctgtcccataacaattctttatttttctctgctgttattctcctacccaatctctctacttcagccacactggtcacttaatttttttttttttaacattcatggaaacttctgtctcagggcttttgcacttgctgctgcttttgcctgaaatgattttccctcagaggtttgccaagctcttcttccccaccttctgagtgaggaatttcctgactatcctatctgaaattgcaaagctccctccaaccccagtaccctccaattctctttgtaactttatttttctctctatattatctgcctatgtatctatgtatctatctatctacctatcatctatctatttttctatttatctgttgtttatatttccccaataaaatatgagcaatgtttttttcctttgttttccgttttatccatttctatatccctagtgcctagagctaagtcctgatgggtgggaggtgttttgtaagtatttgtgtgataaataagtggtgttatccttaatagttgtacaatatttttttataaaaaggcattttgggccaggcgtggtggctcatgcctgtaatctcagcactttgggaggccgagatgggcggatcacgaggtcaggagatcgagaccatcctggctaacacagtgaaaccccgtctttactaaaaatacaaaaaaaaattgggcgcacgcctgtagtcccagctactcaagaggctgaggcaggagaatggcatgaacctgggaggcagagtttgcagtgagccgcaatcgcgccactgcactccagcctgggcaacagagtgagactccgtctcaaaatataaaaataaaaaaataaaaataaaaagacgttttgcttcatttttagtttatctgtttttaaataaattctaattctttagataatagtgggctttagggtcaaggataaagtgggaggatatatcaaaaccacctgcaacacaccaaaaacagaaaaaatcatagacagtgaattttgcaaatgttaaaaataaaccattctactcaaaaaggagagagagagagaagagggagagagacagagagagagagagagagagagagaaattcccaggggctagaacagagaaagtccatcagagttggggttaaagtgtcatgcccaatggcaaagaggaccaaattaggaaaaaagggactgaggtttcagtgcctgttcaggaggtggagttaagggtgtgttggccaaggtggaggaccacagtggagccaccagtggaaggctggaggtgggcaggggtgaggtgttgagttagttccaatcgatgtagaggaagaataacccatgaagggctggagcctggcccatatcacttgcatggggccccaaattgcacaattcaggtggagcagtagccttcaggttctaatttcagggtgggtttagagccctgaaacccagagaaccagactgtgcacatcaaactcatgatggtcttgcctctaggaagggtggggaagggaggtggcaaagaggactttacctacagtgtttattgaaaggaacaatacagatgtgaagaaattgttatcaattttcaattattgtgaaaatgtggattttttctgccattctaagtacttttctgtaattattttaatatcacaattattttcaaaagaaaaaaattaaagaaatagggtagtcttttaaaactaagagtatctagtctttctgtgatatttctagtgacttaggtccacttcccatatactttaactggtagtatcaggagtgattttaaaaaagagcaaatgtctattaatatatgtttttcctattttgtttgaatgataatatatgacaatctgttaaaaagtactttcttgggttaaaagtaaaaaaatgaaatctgattttttccttttgttaccttgatcaattgtgatagcactgacttagatagaatgcaaaccataggacaactcatacaattcccatcctatggcattttatagtgaaggagaattaaagtcaaaagaggcagtcaagtatctttggatatttatacgtaattgtcaagtagactttatattaagtgcatagttgtatgtgttagtgtattgctttattatttatttatttattaaattccatttttattttagatttagggggtacacgtgcaggtttgttacaagggtattttgcataatgctgaggtttgggcttctatagatcctgtcacccagatagtgaacataggatccaatagaaagtttttcagcccttgccccactctctccctccctccttttggagtccacaatggtgtctatggttcccttgcttatgtctctgtgaccccaaggtttagctcccatttataagtgagaacatgcaatgtttggttttctgtttctgcattagtttgcttaggataacagcttccagctgcatccatgctgctacaaaggacacaattttgttctttaaattaaaatttaaaacattttttaaaagaaataatccaagatgttttcttgcttagtgaaaactgctcaggtgtacatctggaatatttatttgctgtaagacttcctggaaattgctactggatataataatgtactattgatatggtttggatgtcccttccaaatctcatgttgagatgtaatcctccttggtgggtggacaggcagggggcctggtgggaggtgtttgggtcttgagagtgcatccctcatgccttggtgctgtcctcaccatagtgagtgtgttctcatgagatctggttgtttaaaagtgtgtggcttctctccccaccaccttgctcctgctttcaccatgtgaagtgcttgctcccactttcccttccaccatgaatgaaaacttcctgaggcctccccagaagcagatgctggcatcatcttaggaaggatgcagcctgcagaaccatgagccattaaacttattttcttatccagtctcaagcatttctctacaacaatgcagaacagcctaatacaactattaatccatattcatgtctataccaacagcaatactttgctgatagcaaacgggtatgtatgctaacactcctgaaaaaaaaacaccttccattttcctcaaggccaatttggaataagagaggcattgttattctgcatcattgcatcatacatcatgctttcagatatgggatttcgctcttgaaatttcaccttttaaaagaaaattctctgcttttcaaaaataaaggtattttctttggagaaataatctccactcaaaatgtaatttaaaaaaaaacatgcttttgaatcacactcttgcatccccttttcactttttgttttggctcactgcagatttgaaagctgctaaacagatcttactcaaattttccaaaacaattctttattggaaaaagattaggaatcagaaacgtaaaattatgagcccaagaatgctcttctaaattttaagaatttgatgaatctagatatttaaaataaaactccttctcttgtatacacttacttaatttttccattgtaattactcggcatttcatgtagatgcacatatagtcaaatttttatatgatctgcttggttcttacatccaatcttggcaactgtggcctgggatgaaagccaaatctgttcctaacagagtgattatccattcttccattacttattccatttagagtatgtggatatgttaatgtctgcagaacattttaagatgttcagagtaaaagagctttattaattccagatttgtgaccaaagatggggatcttttaaatggaaatggcaattgggaaatccaggacataaaagtagaaggggcattttaaccaaggagggatgagaaaggttatgagaaatagaaatagagagatgaaaatataaaaagagatctggatctaacacaatcccaggagtaacattccaggagttctaacaacaactgataatgtcttaacattgatattctcatcaatcgtaactgtgcttggaagtcatacgagacactaataatatagtactcgtgatgggcttaggttatatgccattctcttggaatttcaaagggttagaatagctttcatgaagtgagagtgaagcatgtatgcttgtcttcagaccatcacaactgagaaaaataattatattaataaaagggcttaattagaaaggagccatttgagaagaattaagtcactttgattaatataattacctttctcacagaattaatcaagatttaactttaacatataaccccagatcacttgctagaattctgtgtgtctgaaaaccaagttttgaaactcacttttcatgtagattcattatcctggtgttcccaaacttagtttatcagctggaacaactgtggagctttggccaccaccccagaccactaactcagaatccctaagatggagactgggaatttaggttgcttgcttaaccctctacatcagaggtctttaacctttttggcaccggggcccgtttgatggaaggcaatttttccacaatggggcagggagagggggatggtttcaaggtgaaacttcctgattctcagattcctgaatcctcagattatcaggcatgatttagattctcataagaagcatgcaacctagatccctcgcatgcacagttcacaatagagtttgcactcctatgggagtctaatgccactgctgatataacaggaggcagagctcaggcggtaatgaacgctcacctgccgctcacctcctactgtattgcccagttcctaacgggccacggactggcacaggtccacagccctggggttggggacctctgctctaggtgtttgggcccttgcatgatggggatgagtttcaaatatcaaaacattcagcactttgagtaacttgttaatctttggtatataacataacaataaaatctatcatttattgttgtatactatgtgccagaggataacgtgcattttctccatccacaccttaatgcttccaggcatcattattcccatttgacagatcagaagttaaatagcagagcaagtctctggtttgcctaaggttttacagttagtaaaaggcagagccaggattccggcacaattcagcctaactctggagcttgtgagcttctcagagtagcatccataggatgttatgatccttcatacaatggcctgcccatgtatatgaggtttggtgttggcatatttaataagaagagttttatatttatttccacaaagtcccaataattttcagctggtaagaattctgagttgtgagatggtaacagaattctaagcctggttgtctcacaatcctttagctgataaatgctttgagatttgcattttaattataacaaggacaaaaatatggaaaatacaaaatatattttctctcttcatatggaagggagaagaaatgtcttctcccttaggagctttgtagtaaatgaaatgtcccattcttaagcttttctctctttgccttcttcttactccccttcccacgctaggtttcagttcattcccaacagtgcaggtggctgtaggaggtacaacttggctgaggaggagaaagcccattggtaatgttctcatgttcttctgtagatagagtaagccttttccacatctaaagggctttgaaattggcaggaggattggaacctcaatcctcattcctaagtaatacttctaggtttccagcaactcatttaatttttgattcctgtgatccattcttatataaggttatctgcaaatttgatgtaatctgcattgtacttcaacaaaccacaagtcaagggtttcttactgtgagtttcctatagaaagataatgctgtgaataaaaatcctacaagaaataaaaaatcatggcaggctccgtagaagcagtgaaatatatccatcttttaaatataaacatcctaaaatgttaacgcagaaagagtaatagaaaatacgtgaatattgaaatgaaccaattacgcttgctaataaaggtagtcttgccagtttgcatcaagcttttggttctcaggaccagcctgcatgtgtgttaagagttgctttgtttatatttttatctctctgctacacgctacgcatcaagtaaacatggacaatgccttgaattagaggaatgaacatgtttttcgggcaacctggcaaccgtgctgagggagtgtatttcacattcactttctccactctcctgaagttgtcaggctaagtgcctaccagctgggtgtttacactttggggctaaggaggggaaaatgttttggcttatacacactgacaccaatggctcaaatcccagtaatttgagggacccctgttgttccgcaaattcctgcccattttctagttcacttaaaacatgctgacaattgtcttgtatgttctatcagaaaggaggactctgtcattgaagcaaaaaaccattctgtgcacaagcagagtgtgtgtgattaactcacatctttcatacaaatatgtatatataattatgtttaaatatttatggaataatgatcacatttctatgtgagagaggaacaaaaatagcaattagattgcagcttggctgtggggcatgtgtaataaagcttatcctacccttcacccctgcctccaggctatcagagcaaacttttttgttcaaactattgtatcatataaaattttaataatattttgaaagaataaagggctgtcccttctgtggcattattccacatcctgacctcatctttggtaggatttcttctttagagatatgtactctggcatcatttgaattacggagcagaacaattctactaaaatgcccaagaatacaataataaaatgtagaaattttaacttcttagagacagatgcaaatattcacttctccatgctcacagatgaaattagtaaataaatgaagagcattgatttttattttgttccttttaaagaaacttaacaactgcacaggaatgtaaagatgtatgaagatgtaattatagcacaagccagcatatgataaatactacaacaatggtacaagaacagtcataggagattacagattagggggcctctgtttctagcaacaggatagatgagatcgtctaaaaactttccacacaatacattagaaaagctggatacaattatgacaaacatctttttaaatgcacagttaataatttgtgaaaataatgtaaatttctaaatagagagaatgagaaggggatcttgaaaccaaaaagatgaccccacaccatgcataaaactgtcctgggaaaataagtcactcttagcaaactagagtcttggatttgaaatgggtgcccatgtgaccaagagccaaagcctttggcatgtgcaaagtgaagaagtatatccctgtataaagctagaattcttcaaaagctacacattagactggtgcaaaagtaatggcaaaaaccacaattgcttttgcaccaacctaatatttagccagtgaaatggtgaattaccaaaacaaacccccaaataaaaaatatagattaggaacacggaagacaagaaaatgtatttctcttcacagggggtctggatgagtgaaaatctccttcaaaaattgataactgcaggactgtccttgtagggcaatttggaaacctgaagtggagaaataggcttgctaagaccttgcaggatttagagataaagcccagaaaaacatgagttagcaataaaaaagcaagcttactctgaggaataagcaaccttgagcttgtttgctcaagcacaatttgactacaaggacttcagatactggacttattatatccaaaatttaaatatatttcaaatatataaatatgtgatgcagagatttaataacattagcaaggaaaagagtactatagatcgagtatccctcacttaaaatgcttaagaccagagtgttttggattttggattgttttcaatactgaatatttgcatatacttaatgaggtatcttgggtatggaagccaagtctaaacaaaaaattcattttagaaaattgttttatttttattgatttttttttagagacagagtctcagtctcacccaggctggagtgccacgtggcgtgatcataactcactgcagcctcaaatttctgggctcaagtaatcatcctgcttcggcctcctgagtatctgagactacaggcatgcactgccatgcctagataattaaaaaaaatttttttttgtaaaaacaggatcttgctatgttgcccaagctggtctcaaattcctgggctcaagctaacctcctacctcggtctcccaaagtactgggattataggcatcagccactgtgccctgcccatttatgttttatatataccttatacacatagtctgaagatagttttgtgtgatgtttttaataattttctgcctgaaacaaagtttaaatacttaggaatggaattttccgcttgtggcattatgttggcactcaacaagttttagattttgaagcattgtgaattttagatttttagattagggatgctcaaccagaataaaaaagactgatatatagatgtgtaagaatcaaatagatcttctagaaattaaaacaaaaatgtcgaaatgaattttccattgggtgggataaacagaaaagatacagctaaagagagaattaatgaagtataatataaatttaaatatatttcccaatatgcataggagagagacactaaaacataagaaccaaaaaaagagattaaaggacataaataataaaggatatggtgtaataaatgtctcagtagttcaaaaaataggcctttagaaaaggcagtgaagattttgattttcaattcgggaagcagaacaaatcccaataagacaaactaaaagaaatgcacacaagacacaccacattgaaatattatggtaatatatgcagactatcacagacacaagtcagattacgaacagtgagaaagattatctgcaaaagaatggcaattaggccaagagctgacttctcaataacgataatggaagccaaaagtggtccaataatactttccaaatctagagaggaaaattgtcaaactagatttttatacctagaaaaccaactttcaagatcgaaggagaaattgagacattttcaagtaaatccaaactgaaagtttatcactaatgataccttataacagatatttctctgaaagaggaaaagtaattccagaggaaaagtctgagatgcaagaatagggaacaaagaaatctctaagtttgtaggcacagctaaacaaacatgttataatatgcacaatcttggaaggttaaaaaatataagacagcatggtaggcagaataatgaacccccaaggatgtccatgtcctaattctcagaatctgcgaatgttgttatatgacaaagggaaatttatttacttatttttctctaagcagtccctcctttttcatttgcttaattaatttttttaaaatgttaataactttaggggtgcaagtggtgtttggttatatggatgaattgtatagtggtgaagttgggcttttagtgtacctatcacctgagtagtacacattgtacccaataggtcatttttcatccctgagcccatcccactctccctccgagtctccagtgtccatgataccactctgtatgcctttacatactcatagcttaactcccacttatagaagtgagagcatgcagtatttagttttctgtttctgagttaattcacttaattcgttcttttttatggctgaggagtattttatggcacatacaccatatttctttatccactcatctattgatgggcacttaggttgattttctatctttgcaattgtgaattgtgctggaattaacatgtgcactcaggtgtcttttttatataatggcttcttttcctttgggttgatacccagtggtggatttgctggatcaaatggtagatctacttttagttctttaaaaaatcttcatattgtttttcatagaagttgacctaattgaaattcccaccaggaatgtataagcattccctgacaaaggggaatttacattgcagatggaattaaggttgctgatcagctgactttaaaataaggagattattgtggattatctcctgggcccagtaagatccaaaagggtctcagaagtggaaaagagagacataaaacagagtcagttagagagagatgtgactacaggtgaagtcaaagtcaatgcaatgtgagaagtactcgaccagcaggatgaaatagaaataataaaataaggtagtataaatcattccaaaaaatcagtagtaatgataaaataaaaatatattcaactcactagttaaaaaatatagattgtcaaattgagtaaaaacatcaaaatctagctgttgctttttataagtgacatacctaaagtgtaagaacatggaaagactaatggcaaagttatagaaaaattatgcttagaaaatactaacaaagcatgtggctggtatagctagattaaaagcagatcaaacatttaaaagtaaaaatattagtagtatcaaagaggattactacataatgataagaaagtataatctaaagaaatatacaatcatttcaaactttcacatgtcttaataacatgcagtactttgaaaattcccaaagcaaatcttgacaaatttcaaagagcaattcataagtcaactgttgtacttgaaagtattaatacttcttaatgaatggcagttcaagcagaaaaattaataagtaacttgaacaatatagttaacaagcttgagataatagacctacagagaagctaaactcaaaatcacaaaacacatattattctcaattacacgttaaacatttataaagtgttaccatttatattcataaataggttgcaatagacaaaaaattatatagactcaattaccttatcaactcaaattagtaatcaataacaagaatataacttaaatgaatctattcagaaattaaagttaaaaatttataattaatttatgagttaaaaaaatcataatggaacttaggaaacagaaccgtatgcttttttagacacaatattgaaatttgtgaggcagagctagagtattaaatacttgcattaggaaagaagaaaagtgaatactaatgagataaacatacaaattaagaatttttcttaaagaacagaaaaataaaacctcagggaaagttgaaagaattaataaatgtaagaagagaaactcatttagtatgtaacaaaggagagaaacacaaagtcaaagctgttttatagagaaagctgataaaatagataaagctatagtaaatttgagcaaaagaaataaaggaaaggtacaaataaactattaagaataaaatatgcagcataactacaaaaacagaacaaatttactctttcagaattaatactaaaaacaactttgtggcaatatattttaaaaatgagaaaaaaaatcctagaaaagtatagcttacagaattgattcaagaagaaatagaagacctaaatggaactataatgaatatggcaactgacagtagttacagggcagagattattggatgcttaccaatgctatttcctcttcccggaagtacatctgccttgccattagattgaagctacaagtttggtactagtcagtggaatgagggcgaaaaagataattataggactatcctccaaaatctttctttcttaaaatctttggcttgctttcatttgcagctgaaggtaaagaaatttcatgtggtggattcctacaaaagaaaaagctgcaaaagagtcaaccaggaaaggtgctagacacacatccaatggctgctgagtgatgaatgagaaagaaaccttcggtgtagtaagccattgaaatttgggggaaatttgtaatagctgttgctgtaaacctccgcactgcaaaacacacacatcctagataattaaaagacaacttctaccagatgttgaagggcacatcattccaatcttatgtaaattattccagagaatagacaaagaggaactattcctccaacagattttaggaagccaaaataaccttaataccaacactagtggaaaacagagtaagaaaggcacaacatgatttatatgaggaaatcctaaacaaagtattagcaaattgaatccaacgaaaaatatacttgaattgtgtgcacacatacgaaatcattcttcaattaacaaatatttttaagcatctgacgtatgccaagcagcaacataacaccttgagacgtcagagatctttgcccttgtaaacctacattccagcagaagaaaatagagaatctataaataatagagacttcctagtgtcatccttgactgaggcaatctttttcttggtgctgcctaaaaacgcctttgttttttaaaaattgtatattattgatgactcatactagcttatagttaaaaggaattccccaacctttagaaaagtatataaatcattataaggaccagtttacttattatgatgtatgttgagtgttcaaaacagcaaaaaagagtaaaataataaataccacatccacccacagcttataaaagaaaactctgcccattctcctgtatatttctctgtgctgtttctttcttgccacatagggttaccactaacctacattgttttccatttttattgcacgcttatatgtatttttaagcaatagaagctattgtttacaggttttagaactttattaaatacgtttatggacagtaactaattccatttgtttaaacggtttggcataaaatagtaaataattcacagctagtaaaaccaaaaaacaaagagataacaactatttgctgcttacaaggaacaaataaaataaaaaactttaaatatttaattgaaatcacaaccatcctgatataataaacatactagctgtaagacagagtggtcatgctggacagcatcttcaagaaaccctccctgtggtttttatttgatccccataacatctattttaaatcttcttaatggctttcaataacaacttataattatatttgtaaagatcaggctcacttttttaacagattgctaagtctcatataattcattagggcaaattatattgtttccaacagttcatttttctgttgttgctggtgatttctattgatgtaatgaatttctataccgatttatatccagctatcttccaaaactctcttgtattaattctaataattattttgtagattatcttgggtttttctaaagatataattacattttctgcaaaaactaatagtcatgtttctttataatttttataaattttacttcctagtctattcttattggatgaccattacttctatttaaatgttgagcagaagcagtgcaagaaggcattcttttttttttttttttttttttgagacggagtctccctgtgtagctcaggctggagctcaggctggagggcagtggcgtcgcgatctcggctcactgcaagctccgcctcccgggttcacgccattctcctccctcagcctcctgagtagctgggactacaggcgcccgccaccacgcccagctaatgcttttttgtatttttagtagagacggggtttcaccgtgttagccaggatggtctcgatctcctgacctcgtgatccacccaccttggcctcccaaagtgctgggattacaggtgtgagccaccgcgcccggccaaggaggcattcttgtgttattccagattttaaaaagaacactgctaatagttcagttttaagtacatttgttacaaattttatcaggttaagaaattccctttattatattaccaataattgttctcatacaagttatttttatttccgctgattttacagatttggaaagtgaggcgtacacaggctaaataacttgcttaatgaaacactggtcacagagtcagaatgtgaagaacaggttgtaggactgcaaagctcttgctgggactgtggtcgtaggcttgctctccgctttgggccccactacgtgattaaaaatgaaggcttaggatatgtttacttggcaaatatcaacaggaagcagttggagcaatataaatttcagacaaagtaaaatgaagccaacagcattaaaatgagacaaagagggtcattttatgttatcaaaagttatggctcagaatggtataaattatgaattgtagcatatcatcaagctatcagacaaatacatggaaattaagagaaacaaaactctgtaggagattttaacatttctacctcaccctttaacagaattaaaataataaagaataaataatgacacaaattatttgaataccataattaatacattaatgttatatatcattttctcttggacatctcaagtattaacaccattaacaccccaaatacaatctcaataaattccccaaatcaaaaattatacatatatttctttccataaagcaataaatctagaagttaataaatttttaaacaaaatagtttgtctaagaaattttttaaaaatcactcttttaaagaactattgtgtctgggtgcagtggctcaggcctataatcccagcactttggggggccgaggtgggcggatcacttgaggccaggagttcgagaccagcctggccaacatggtgaaaccctgtctttaataaaaatacaaaacttagccaggcatagtggcggacagctgtaatcccagctactcgagaggctgaggcaggagaatcatttgaacccgagaggcagaggttgaagtgagctgagatcacaccactgcattccagcttgagcaacaagagtgaaactccatctcaaaaacaaaaaacaaaaaacaaaaaaactattgtttcaaaaatgaaataaaaactatagttggtctttcaaaaaacaatatgtttcagaacactaaaatttatagactatagatacattgtaatttaaaaaatttacaagcattagtgattttgtcattaagcaataaagaattaatatttcatgaactaaactttatattcaaaaagtttaaagaatcagcaaagctaaagagataagaaagataaagaaaagaagaacaataaattatggagaaaagcaatagagtgtatagggttaaaaactggttgtttgactctcaataaacttggtagtgatggaatgtatctcaaaataataagagctatttatgacaaacccacagacaatatactgaatgggcaaaagctggaagtattccgtttgaaaaccggcacaatacaaggataccctctctcacctctcctattcagtatagaattggaagttctggccagggcaatcaggcaagagaaagaaataaagggtatttaaataggaagagaggaagtcaatttgtctgtgtttatagatggcatgattgtatatttagaaaaccccatcatctcagagcaaaatttccttaagctgataagcaatttcagcaaagtctcaggatagaaaatcaatgtgcaaaaatcacaagcattcctgtacaccaataatagacaaacagaaagccaaatcatgagtgaatgcccattcacaattgctacagatacctgggaatccaacttacaagggatgtgaaggacctcttaatggagaactacaaactactgttcaaggaaataagagaggacacaaacaaatggaaaaacattccatgttcatggataggaagaatcaatatcatgaaaatggccatactgcccaaagtaatttatagattcaatgctatccccatcaagctaccattgactttcttcacagaattagaaaaaaactactttaaattccatatggaaccaaaaaggagcccatatagccaagacaatcctaagcaaaaagaacaaagctggaggcatcatgctacctgacttcaaactacactacaaagctacagtaaccaaaacagcgtggtaccaaaacagatatatagaccaatggaacagaacagaagcctcagaaataacaccaaacatctacaaccatctaatctttgacaaatctgacaaaaacaagcaatggggaaaggattccctatttaataaaaggtgttgggaatactggctaatggctagccagtacttcttccttgcactttatacaaaaattaactcaagatggattaaagacttaaacataagacctaaagccataaaaactctagaagaaaatctatgcaataccattcaggacataggcatgggcaaagacttcatgactaaaacaccaaaagcaatggcaacaaaagccaaaattgacaaatgggatctaattaaagtaaagggcttctgcacagcaaaagaaactatcatcagagtgaacaggcaacctacagaatgggagaaaatttttgcaatctatccacctgacagagggctaatatccagaatctatgaagaatttaaacaaatttacaagaaaaaacaactccatcaaaaagtgggtgaaggatatgaacagacacttctcaaaagaagacatttatgtggccaataaacatatgaaaaaaaactcatcaacactggtcattagagaaatgcaaatcaaaaccacaatgagataccatctcatgccagttagaatggcgatcattaaaaagtcaggaaacaacagatactggagaggacgtggagaaaaaggaatgcttttacactgttgatgggagtgtaaattagttcaaccattgtggaagacagtgtggtgattcctcaaggatctagaaccagaaataccatttgacccagcaatcccattactgggtatatacccaaatgattataaatcattctactgtaaagacatatgcacatgtatgtttattgcagcaccactcacaatagtaaagacttggaaccaacccaatgcccatcaatgatggactggataaagaaaatgtggcacatgtacaccctggaatacaatgtagccataaaaaaggatgagttcctgtcctttgcagggacatgaatgaaactggaaaccatcattctcagcaaactaacacaggaacagaaaaccaaacacagcatattctcactcataagtgggagttgaacaatgagaacacatggacacagggagtggaacatcacacaccggggcctgtcggtggggtggggagctagggaaggaattgcattaggagaaatacctaatgtagatgacgggttgatgggtgcagcaaaccaccatggcacgtgtatacctatgtaacaaacctgcacattctgcacatatatcccaatacttaaagtataacttaaaaaactggttatttgagaaaaacatgaaatagacaaatatctataaattataataaaaggaaatacaaatttacaaaatgagaattgaaaaggcaaaaagaggcacaaagtagaaatacaaaacaccaatgaaaagtggaaaatatgctcactagtaagcaaaatatagacactaaagtactgttcttcactattaatataagaaattctggctgggcatggtggcccaagcctgtcatcccagcactttaggaggctaaggtgggcagatcacgaggtcaggaggtcaagaccagcctgaacaacgtggtgaaaccccgcctctattaaaaattacaaaaattagccgggtgtggtggtgggtgcctgtaatcccagctactcaggaggctaatgcaggagaattgcttgaacctgggaggcagaggttgcagtgagtggagatcacaccatcgcactccagcctgggtgacagagcaagtctccatctcgaaaaaaaaaagaagtgtttataataatactgaattcaagatcatagtaacgtgtctgttttttacatggcagctagaagttggcacatcatttcccaaaaggtagcttttaaaaagtcacacattttgactcaatatgaatctaacccaaataaaaaattaaaatatcccaagacttttgcacaagatccaattttaattttttatttataaatgaaaattaggaataaatcattatgtacaataatagaataattgaaaattaaatgagataaaaccacatgatagaatttttagaatatgactgatgcaggaaaatgcttactaaatagtttttagtgaaggaaaaagtaggacacacctgctttttacagtatgtacagtagactcatggcatttaacattgtaacctttgattacttaacattgggtggtttgtgatggacctctgtgatctatggtgaataatatgttttcatttggagagagagcatataaaagattacagatcatttcctagtcaatgtttatatatatgtctcatacataacaacttatttgttttataaagctctataaaggcattcctaaattctttgatatgagaatactcaacagatatgagtatttgacatattttgtttttcctacagaacatcatcatccaaatccccttttcccctccctgactccaaatatttattagaacctgcagcataggagtgggtgtgctgggctggatacagaacattaggctgacagattttgactgtcagttaatgtaggagatttctgatttgatctcacaatgtcccagcaccaagttagtgaggatgtggctgcttggggttcgggtaagcgagtgtcctggtagagcatactgttttaaagctcagcaactgtagaatgaaagaatgctccgaagctaagacctcttgactcattatgactaatacatctcagagctgtatcgtaaggcaaatcagttctttataaataattaacttgggtcaacctgaggtcagagataatttgaatgctacatgactaaatgtttcctaccatctagctagtcttgctgactccttgccaaaagctgtgggagcccacctcttgtatcagcgtgatctggatgtgagacatggagtcaaaggtgatcatgttggaaatgtaaggtttaatgactgccctgttggatctaggacttgcatggggcctgtcacccctttgttttggccagtttctcccatttggaaagggtgtatttacccaatgcctgcacccccattgtgtctaggaagtaactaacttgcttttgattttacaggttcataggcagaaaggacttgccttgtctcagatgagactttggacttggacttttgggttaatgctggaatgagctaagattgtgggggactgttggaagggcatgattgtgttttgaaatgtgaggacaagagatttgggaggggccaagtggggaatgacatagtttggctctgtgtccccacccaaatctcaccttgaattttaataatccccatgtgtcaagggcaggagcaggtggaggtaattaaatcatggaggtggtttccactatgctggtctcatgataatgagtgagtctcacaagatctgatggttttataaaggacagtttgcctgcacaagctctcttgtctacagccatgtaagacatgactttactcctccttcaccttctgccatgattgtgaggcctctccaaccatgtggaactgtgagtccatgaaatccccttttctttataaatttcccagtctcaggtatttcttcatagcagtatgaaaatggactaatacgcttctcttcccacttcaggcctcacttgaatgccatttcttccaaagagcctcctttgaccccccaagagaaattgtattcccttcttatgttcaagagttttcagtttcatcactggcatctcttatacatcttcattcggacttaaatgctcatagagtgaagaaaggatggacgtattgtgtttacttaatggttcccagttagttccatcttgggaatttgaagctgggagtagatatttgatctcttgattctgcttgtttgtaagagtctacagtgttagttttctggaaggcaaccctattgtttggggcaacaaaccactaggaaacattaggactgaaagaccaggtgaacttgagattactattgctgagtaggatcatagggtacactttagtattttgcttgtgcttttcttattatcaatttaatacaagttcatttaaaaatgtagaaagaatatacaatgtaaagaggaagaaaatacctcatataccttgtatccagaagcaaccaggtcatctcttagcattttcatttcctttccagctggtataaaagattttcagtactgagagagctcttagaattcctctcaggctcactctaagtcaggactctcatcttcctgtctgttatcctttctattacttcataataccttattttaaaaaattaaggaaattacaggttggaaaagataaaccaggctggaaatatggagagtatgaaaagtggtaaagaaaaacaaaccctttaacatctattttctcagcatcacagagagttgaacttgtatagagtttgaactcccctcaattagaacctatagataaataattacaaaattcaaaatccaaacataccacagcaaatcaaagcaaactaaatcactccaacagcctgccctcccacccaccaaagtgacctataagaattatctaccaaatttatactatatcttgattattaagtccttaagttaaaattactgcagacaaatttagttactttactttcctacatttacacaatatttcatgagcttataacaaacactttgattaaaactcaatggtcaatatgttagcgattttggacaaggtaattttaaaagatgtaggataatttaaagtgattatggtaaataaacatggattatacaaaaatttatttccacagcagtagtaattatagaataaaaaattagaaatagcaaaaatatttcacaataaaagcttggttaaattcctacatttcaataaaacatgatgtcattgactgttggatagtgatatggtttggctgtgtccccacccaaatctcatcttgagttcccatgtgttgtgggagggacctggtcggaggaaattgaatcacgggggcaagtcttcccgtgctgttctagtaatagtaaataaatcttgcaagatctgatggttttaaaaagaggagtttccatgcgcaagctttcttttttgcctgctgccatccgtgtgagatgtgacttgcttctccttgccttctaccctgatcatgaggcctacccagccatgtggaactctagtcagttaaacctctttcttttgtaaattgcccagtcactagtacgtctttatcagcagtgtgaaaacaggctaatacagtacattggtaccagtagatggggtgctgctgaaaagatacccaaaaatatggaagggactttaaaactgagtaacaggcagagtttggaacagtttggggggctcagaagaagatgggaaaatgtgggaaagtttggaactccctggaaacttgttgaatggcttagacagaaatgctgatagcgatatggacaataacgtccaggctgaggtggccccagatggagatgaggaacttgttgggaactggagcaaaagtgactcttgttatgttttagcaaagagactggtggcattttgcccctgccctagagatttgtggaaatttgaacttgagacagatgatttagggtatctggtagaagaaatttctaagcagcaaagcagtcaagaggtgacttgggtgctgttaaaggcattcagttttataagggaagcagagcataaaagcatgaaaaatttgcagtctgacaatgtgacagagaagaaaatcccattttttgaggagaacttcaagctggctgcagaaatgtgcttaagtaatgaggacctgaatgtaaatccccaaaacaatgaggaaaatatctccagggcatgtcagaggtcttcacagcagcccctcccattacaggcctgaaggcctaggagggaaaagtggttctgtgggctgggcccagtgttcccatgttgtgtgcagcctaggaacttggtgccctgcttccttgccattccagccatgcctgaaaggggccaatgtagagctcaggccacaacttcagaggtgcaagccccaagccttggcagcttccatgtgatgttgagcctgtgagtgcatagaagtcaagaactgaggtttgggaatctccacctagatttcagatgtatgaaatgcctggatgtccaggcagaagtttgctgcaggggcagggccctcatggagaacttctgctagggcagtgtggaagggaaatgtttggttggaggccccacccagaatccctactggggcactgcctagtggagctgtgacacaagggccaccatcctccagaccccagaatggtagattcactgacagcttgcaccatgcacctagaaaagctgcagatactcaaccccagcccatgaaagcagccaggagggaggctgtaccctgcaaagccacaggactagagctgcccaagataggaacccacctcttacgtcagtgtgacctggatgtgagacatgaagtcaaaggagctcattctggaactttaatatttgactgccctgctggattttggactttcatggggcctgtaatcccttcgttttggcaaatttcttccatttgaaatggctgtatttacccaatgcctgtacccccattgtatctagaaagtaactaacttgcttttgattttaaagatcatagacagaagggtcttgctttgtctcagatgagactttggactgtggactttttagttaatgctgaaatgagttaagacttgggggactgttgggaaggcatgattggtttttgaaatgtgaggacatgagatttgggaggggccaggggtggaatgataaggtttggctttgtcttcactgaaatctcatcttgagttcccacatgttttgggagggaccaggtgggaggtaattgaatcataggggcaggtctttcctgttctattctcatgatagtgaatatgtctcacaagatctgatggttttaaatccctgcacaagtttttttttttttgcctgctgccatccatgtaagatgtgacttgcttctccttgccttctgccatgattgtgaagcctcccaagccacatgaaactgtaagtccattaaacctcttttgtaactttcccagtctcaggtatgtctttatcagcagcatgaaaacaagactaatacagatatcatgggactatgatcacaatatttgaactaaaaagctattgtcaaatactataagcaatattattctatttgtggaaaaatatattaacacttggaaaagagactgaaagaatattgatcaaaatctaaagcaggtttatttgtgggttatgagatctggtgacttaatatttttatttgtgctttttaatatttcccaaattttctacaatgagtatagattgttcagtagattgttctgaacataaataagacagattatctgtgtgaaaaatattagaatatttatggagaacaatctacataaacagattgtagattgtagaattattaacctagagtatttgggctcctcgaatgcccataaatgggtgtcaaagagtctgtgtaccctgtggaataatttgtatgtgtttgtatatattgttgctgatggaaggggatccacatctttcacaaaattctcaaagtgctctgtgatcctcaagacctaagcaaaagtactttgcagcaacctgttctaaatcttgtttatgacaatttaaagtcggtgtctctaggctcctcatttcaaagattgtgcatatataaactgttttggctcatgggccattcacagtgaaagcatttgggttaaagccagaatatttatgggagtaaataaaattagtatccacttgaaatgacagcagaaaaggtaagttattttttgtttgataagaactgtatcttactaccaaaactctctaatacatcctgaattattcaaaattaagactcaaattttcacattaaagttgactagtgtaatgatgtgtttctgttaaaaatcctcattatgaaatacattttgaaacattacctactgaataaacattcaactttgctttcttttgatccctacttaaatcaccatataacactgacgtcttactctgtaagtcttcacatggtctttgatcaaaagcagcgtaacctgaaaatgacctttataaatggacttacattttcctcttgtgaatggagatagagaggggctgaaagctgctctgtgcttctttgcctaacaagcctaaaaatcttatgggaaaaatgtcaacatcacccagacatttgaaaccctgaagggcattggtttgtcatttattcaaaaattaagttttctttcattttgcctttacactttcattttggataattgtgcacataaacttacacacacttctttcattcattaactgaagaattgcactctggttacaaagaccacatcataagtacttactaagttataagttaaaaagaagtggattcatttttaatttattattcaataaaattcttatttcccatttgggacagatgcagaatttgtggttcttttaaaatagcagcctgcaggcttatttctatccagagaacagtacagtccttttgagtttgaccctataaaatgttttgcttatttactttttaatttcagggttgatcgttgcagtcattacacacactggttcatggtgaacattggaagcttgcctccatattctctgaccaaagaagccacgtagtggttctcccttttaaaaaagttctttacaatcagctgcagccagtttttgattttggagaactttatctagaactgtgacattttgtggagttttatacattggaatgtcctgttcactaacccattgataggagaggggtgcgacccccttgctgcaactcactcactgcttctcatttggtgattgatcaagttctaccatatagactactgaagttttcattatgaactgtcaactcttaaggataaagagcattgttccaaaagacatctttttaagaactaggaagagtgggaagaatattagcctcctccaagtcaataataaggattcttattagaggattctgatgaggccacttacacatgtatagaaagacagggccaggtgtggtggcttacgcctgtaatcccagcactttgggaggccgaggcaggcagattacttgaggtcaggagttcaaggccagcctagtcaacatggtgaaatcccatctctactaaaaatacaaaaagtagccgggcatggtggcaggcacctataatcccagttaccagggaggctgaggcaggaaaattgctggaacccaggagacggaggttgcagtgaagccaatgtactccagcctgggcaacaagaacaaaactccgtctcaaaaaacaaaaagaaagacaaaaatcaaggatctacaacatatggaagaagaaggggttccctgaagatacatctggtaatttcactatgttttgcaggccaagacttaatagtgaaaataattcaacttttcagcttaaaaacaaaaaacaaaaaaacaattttctcctaaacatgtaactattgaaaaatctaagatacagggaatcagaagcaatgtatgagagaaggcatatgtttggttaatgtgtttcattatatgttaaatgtagttccccactactgatgttcaatagataaaaaataagcaaaatgtgtgaaataaagtgctattatagaatagtgcaaaaactttccaatggtaggctcttgtctcttttctatagacttgtgatctgtggggatgtgctctcatgctcttcattaataccctgctccaccccatcgttaaatattccagacttttctaagtaaataccatccaacaacagaatacgcatctttcattgtcacagttagctgatatctatggaacgctccacatttctccataacttcaatactgaagcatgtgcctattcgtcattctttttgccaacccagtgacttcaacactactcttggttttcttggttttccttctctggcttacccctatgatcgttacaaaaaccacggtttccatctccattccaatttagccactatgtttatagccataatttaaatctaatcatcagtcaagattactttattgctaacatcctaaattctaacatttcctttttttcttccacaaagttttgttttactgctccattcattttcttaactttactaatcaaatagttatccttcttttctacttcagttccttattgctcctctgattttccaatccagtggcactcaagctttggcatacattagaatcacttgttgaaacacaagtgtagatcgtaccctccagagtttctgattctgtaggtctgagatggggcctgaggatctgcattttaacgggttccgagtgatactgatgctgctggtatgaaaaccacactgagaaaaataatctttgttcaataaaactcttgttccattagagaaataagtgattgggaagtggaacttacaagggtggttcaacatatacaactcaatcaatgggctacatcatatcaacagaatgaaaaacaaaaaccatatgatcatttcaattgatgctgaaaaagcattctctatctcgtctgttttttatatcatccatcttttaaattttggggaacctattgggtaaaaaataatatcttactctttaaactggtatagtatttttttctatcatgactcatgtggctaagcatgtttttcatatttgttgtttgtttgcctttcatttatgtgaattgactactgaactcatttctgtttatttctttctcagtgagtgataggaatttttatacattctggttgctaattcttcatttgttattatacaacacaattttattagtctttcacttgtgtttcaaccatgaataagtattttttatatattttaattattttaatataatcaaggttatctattttttttacactaccatttttgggtttttatcctagttagcagggccttccttatcctggggtcattaacgaatattagacctcttttcttttctttctttccttcttttctttttctttctttttctttctttctcttctttctttctctctctttctttctttttcctttcttccttcctttttccttcccttctttctccttcctttctctctctctttttctctcctctctttctctctttgtttcttctttcttcttttttctttgagacagagtctcactctgtcacccacgctggagtgcagtggtgcgatcttgggtcactgcaacttctacctcctgggttcaagctattctcatgcctcaacctcccaagtagctgggattacaggcatgcgccaccatgtctgtctaaactaaatcttttcctgatgcttttaaagatttaaaaattttttgctctactttttaaactttccgaaattattttttctgtatactatgatgtaaaaaatctaattttaattttgtccttattaatagtccatcttttatttatttccagtgctacccctctcatagaccaatacccattatatgtgagtttattctatttgattggacaatttacctaatatggcaccaatgctacactattactatagctttattaaatgttttgatatctggtagaacaagttctcccatttacttatttttcacaaatttctttttttttaaatgatagcaagtttattaagaaagcagaggaataaaagaataggcaaagcagccacaaatttcttatattctcttgtaacttacttctctgtgtaacttttagaatagacttgtaaagttccacgaaaaatcttgttgagacttttgtttgatattgtgttgaattcatgcattagtttagaggaaattcacatctttaaaagtgtggattttctcacctacacacatcttaacctctccacctattccagtgttcttttatgcccatcaggaatgctgtatcattgaatccacaaagatttaaccctcttgtcattgttaaatttattcctagatacttaagatttaactgaaaaagaaaacattcctttaacgtcaatcctctctcttgatctaatcctgacactctaatttcttaaactgtccattttttgaatgacctgtttggagagtctgttttctccattttcataccacctgctatattcccttgcaatatggctttctttcctgacactgtagaaaaagtattctttaaaatgttgctgatgatacctgaattgcctaattgcataattttttctcagttttaatcattctcaatttctctgcgttacttgtcgttattgatccctgcacctatgtcaatactcctccattgctgtccatggcatttcactgtcctgttttttttttttttcctattacactctcattgcttcttatctagctttttattctcccactctgtgaacatactgttgttgtgacctctttctatatgctttcttcccatgcatttgaggatgacagggatttctatatgctcccaacaatgattttcgtgcttggcaggttatgggtggtgaataaaggtttcttgaacaaacggatcaacctaatcatagctttcaaatgcttattaacaggaaagtcaggtcactattgattattgggcaaatttgaactctgtttaccatttctgaggctacattatggtctcattttactttcagtcgtatttttctcctccactgtaatcaaactgttaactgcttcataatattgcctttgttcctgaggttttctctacctgggattccttccacttttatttgttgaactcttgtccattacttaagaactatatcatctctctccttttcttggaagtcttttctcattcttcctggtttgatgtaatctcttccacttttgaatcttcagagacactgtctgatttctgctactctcattgcatttgtattcattaataataaaaactgtctttaaaattggcacagattaaaaagaacgataattcccaatcttggcaaggtgagggaagagaaagtttcaaaaattcttgataggaatttctagagcataatttggcaacatgtgtcaaagccttaaatatgcaattagtccatggtgcagcaatttccatttccatgaatttttcctaaggaaatagtcaaagatatgtgcaatattgctcattataacatgtttttgtaaaagtaaaaaaacctgtaaaaacctgtgtccaataatctagttttggctcagcaaaccttagcatatctataatagaagacaacaaaaccaaaatcattttataaaagaatatttatttacatgggaaaatgttcacaatatgaaaaataaaacaggacatacaacaatttttctagcataatgtcattatttcagaggaaaataaatgtgcttagaaaatattagaaagacatttaaaatgctattaatggttttgtgagattgtggttgatacgaatttttttaaagttctacttttctatcttttcaaaattttcatatgtgtgcattttgtttataatttatatccaaatggactacatgatatgttgcccaggttcctcctcctctcttctctaccctcatctattaagacgtaggctctcattcacctgctgctggaggactgaaggctgacctccccgtgttgagacccagttctccaatccagcaactgcccttcactgagcaaagctgccactggagagagttgcctcttccaaggtcacatgcccttcccacaggaagtctgcatctagtgactgtagttataggactctaaactcctatcccctttaccccaatttgagagaatgctacagggccatccagcttcagatttcactctgcaattagttgtgggctttcttaaaacttcttcacgacccaccttctccctctgtctgatcatggttctttccttccccctacagctgtcaatcctgagagcccaccctagtaaacttcctacatctgctttacagggaagctcacctggaacatctgtttgcttggcactttacacttattacctcccaaaaccttgcaataggattttagggcagttattggcgtctctgtttttcagaagaagaaaactacattcaaaatgtttatgtattttatgcaaaggtacactattaataaatgtcagagccaggtttgaaagtagctgtgtttggatataaaaactatgctttttccattaagccaaatggctctctgcagtcagttgtgtgctttattatttttgtgcttttctagttctctctggtagatggtaaattcgttggctgcagggattttatcttatttgtctttgaatcccctgcagggtattgcatagtaccttacacataataagtgctccatgtttttagaattgacttgaactagttgaggcttgaaatgtagttctacttctgttccacaaaaaaacagattccctagcaggaaaagaaaatcatgatggtaagatttagaaattgttttttgatttaaatttcatgaaataatctcctaaaaaagagtgatactaattttcttctctttgcttaatattagataacaaaatgcaattttccagaactttgcttataattactaaaataaacaaatcagtgagtgtaataaacttatactgaactgtgatggcaaatactatggtttttaccttatatccctgattcagggttctctgaaatctaagtcattggagaagagaatctactaagagtagaaaaatgtaacaaggaaataagcttgctccttacacaagaattgaaagtattctaagagtcttaaagtttttgtggcagcagagatgcgtgagctgacatttccagcaatcaatggaatttgcaagtgcgagatgaattttccttaattaaaatctaccagattaatcatattttaagtacaagtaaaatgaatgtataactaattagttatgctgttaggaataaatgacattaggttcatgtttacatttagggaggcagacatttgaaagtaaactacaaagactgctgctatggtctgaatatgggtgttctcacaaatttatgcattagaacttaattcccaacatgatagtattaagagatagggcctttgggaagcaattaagtcataaaggctttgctgtcgaatgggattagtgctcttatggacagttgaagggagttgcctcaccccttccactctgtgaagacacatagaagctgctattatgagcaacaagccctccccagacactgaatctgctggctccttgatcttggacttcccagactccagaactatgagatataatttctgttgttgataaattacctagtctgggatattttgctgtagcagcctcaacagaccaagacaaacacagagtagagaaactttccatattgactgagttttattgttcttgcactccagagaatcaacatgaaaggatatgtctaacaccaaataggggttaattagttgaagttattaaagccagaaggccctggcaaatggcataacatagctacagcatgcatggttggtaactgacccaaattatgctataaaaatggtcaatgctacagcctggatattctcctagtggataaaatatgaagccacctaggtgagatgattttaggtgccaccacactgagtgggtcaaacaccatgagtcctagaattctactgttagaaatttatcactttggttgaccactttagctcctattacaatatgtatttcccagagaagctaatactcatcagttccttaacacagatatgccttttattgaaaaaaaaaaaaaacctacagaaatagaggtctggaagcaagaaatatagtttcaaaaatcaaatgggacaggccataattataattgcatatggttatgatcaatgctgaaccttaagcctgagacctaaaatcaatctagctttcagtcaacttactttagtctgtctcatcatattatttccttttatattagcctgttctagaagttctgtaaacatttccttgaaaaggtaagcaaccatctctaaggctagaagatcaatctcattgattatatttttccctgaactctagttcttccttttcagcagaaatattactgtccttagtggctcaagcctgtaatcctagcactttgggaggctgaagtgggtggatcacctgaggtcaggagttcaagagcagcatggccaacatggcaaaaccctgtctctattaaaaatacaaaaattagccaggcgtggtgttgtgcacctgtaatcccagctgctcatgaggctgagtcaggagaaacgcttgaatccgggaggcagaggttaccgtgagctgagatcatgccactgcactccagcctaggcggcagagcgagacttcatctcaaagaaaaaaaaaaaaaaagaaatattactgtcctagaagaaaacctctttaactcttatttctttcccctctattataaagtgccaataaaaaaggcttccagagcatataggtatttatattaaaacaattaaaactactgtttatctattaactccatatattttcaaaagaccactattaggttacccgcattctgtccataggcccatcctgatagaggctttccttccagttctaaggtgagattaatgtcttcttgaaaatgcttagaaattttgaagtttctgttttcagttgaaatttctcaaattgataaaccttttcaactaataattatattagtttgttttcatgctgctgataaaggcatacctgagactgggaagaaatcagaggtttaatggacttacagttccatatggctggggaggcctcataatcatggtggaaggcaaggaggagcaagtcacatcttacgcggatggcggcaggcaaagagagaggttgtgtagggaaactcccatttttaaagccatcagatctcatgagactcattcactatcatgagaacagtgaaggaaagaccttcccccataattcaatcacctcccaccgggttccttccatgacatgtgggaattgtgggagttacaattcaaggtgagatttgggtggggacacagccaaaccatatcaataatcattccttttaaaattgcaaataccatcagtaaagtcaattgtaactctttgttataatttacatttacaaatatgttgtattaatattagaaattataagttatattaatatttataaatatgtttgtttacatttattctgttacagttgactactgatggtatttgcaattttaccatttgtaacatagagtcatttgtaaattaatacaaactattttaagcctttgatttcttttaattcctaccttagggcattcactgaaagaatgagattaacttgagggaaagggagaacacagagaatggggtggtaaaaagatattgctataaaagtctttgggtagcagaaaaagactagcattggggcataggaaaagacatggggtagtgacagacaagtgtttgtatcgaaattctgccttaggtggattttgattaggatgggagagagaaagagtgagaatgagaataagaatcacacacgcgtgcgcacacacacacacgcacacacacacgcagagcaagctctttgttacttcatttctgccttctttctatcttcacccaagacaagtgtcttttttgctatgcgaggacttaaactaggcttttttaaaccgaatttgagctatactctgggctaattgattcttgcaagctagtctggcatttatggtgcctgcttttgagaaaagatgcctttgcaaatctgaacaataagcacttaggaagcctcttacaacaaattgacttataaatcaggcacacagttacagatagcgttttaacaagagaaagcacctactaaagaagtcagctgcccatcagatgatgtgaaataaatgtttcttattgagcaagtagaaaagaatggtgagctcgttcattttacagtcagaccatccccatgtggcagggtgggccaactaaagagggaaatgtgagccgttaaatatttagtaattatttggtgtataaaaactctagccatggaaatagcttatccacttaaaattgtaagtatattttgtaggaattttaatgatgtgtatgcattttgggatcaaaagatacatatagaaaataaaatgaaacaataaacacattgttcaacacactcagaaaagctacttggcaccattttaaaaaaatatatgttacgttcattttgcctttggctccttcatcttgttcccttgtcaattacctgtccctctccaaatagcccttttctctttccctattcttagaaggctcttttccctaagataattcagcactctctttcctcactcctgtatctttctagggagtatggtgtacagggtgatgtttttctctgctcaagtcattaactttgttagaagagcaccagacagagtcagtaggattcttcccttctcagtattaactaagcacctgtcaaggttatgttttcaggcaaagtttatggttggtacacagagggttagaaccttaaccatgacattatggagcacatggaacctgaaacttctgaaggaaactttccacttcagcttttggcaagaaaaataagacggagagaagagagggaattagatcatgacacatgttactcagagaaaaaaaaaagcaggaggtagtttaagaaaatggggtgaaggaaagcctaagagacaaaattctggcatcactttcctacctaggaaagtgctctcttctttcttatatctggcttctaagctaattttttaattattcttactgcctctatgttcctcaatacttcatttttaatgaaacacatgtttaaggtcattttcattatttatttttctagggagttctttctccaacttcagaactctctctaatattcttgtggttattcagtcttctttgatttttaagggattgtcaaggttcctgaagcaatgtattttcttgttcagcacagttttcagctgtgctcaatatttggattattcaaaagagagtattttgttttccttctggcgtgattcaaagtatgtagagtagtcccctcttatctgcagagtatacgtgccaagactcctgtggatgcctgaaaccacagagagtacctcactctccatcgacactatgactttttgatctgataactgagacaactactaagtgactaaccggtgtgtggtgtacatggcgtggatccactggacaaagggaggaatcatgtcccaggcaggatgcagtgagatggcatgaggtttcattacacaactcagaatggcgtgcaatggaaaaacgtatgaactgtttatttctggaattttccatttactttttcagactctggttgactgaaggtaactaaaaccacagaaagtgaaagcgcagatggggagggggaactaatgtataactatactttaataacacaaaaattaatgatgtagtatatttgctaagcaaatctggcaacaagaaggaagatggaaaacctcagcatcctgaagagtagttatttatctcagaatgaaattaaattttcaagagggtgggaaattatattccaacgataggatgaagagcagaaggagggttaatgtatgctaatattttagggaatatgagatatatgaatttgggtaagcttttttgttttccctttatcgtaggagaaaataatgttgtgtatgcattgaaaaatgcccattgaaaccatattttacgtaagatgtatacaatgctgacaaagattagtttattaatttataatgagtagaactttcatggaattacaagataaaacactatttctggtaaaaaggcagaattaagtaaagtaaaaaaattatctttacattttataaatggtcttggaattcagaaacttggtatatgtaaagtaaaagaaaaacagaactgcatgttggaaagaaattctctaatataaactgtaaaataaggaagattgttttttaaaatcctggattaaattacattttgataaaatatttgactttttcaaatgatgctggtatctgcttccatctaaagacagcatatgcttcagcttgaaacacatctatttctgttattagattctccttttaccataattgttcttgtttaaatcaccatttacctaccttttcatcacgactttaaaaattcctgtattgattcaatattatgatatgagaccttttaaagaagtatcttttttatagaaaaaaaatctgcttatttggaaaatgtgtaaaatgatggaagaggatactagttagtcatcaaaacatatttcctcttcttaattagcacacagttatgccacatttccaagtctcccttgcagtaaggtgcagccatgtgactgagttctagccagtgaaatgtaagcagaagagatatatgttatttccaggcctggctcataaaatgcaccctacatgttctctttcctgcaactttcttccttcaactgattgtggtggaaacaacaatacaaactttggaagcctcattttgagggtgtcagaacattcatcagagatataaatatttttctgtaaggtatgaggtattatacatttttagagtcgttttatataagcttagcctagagttattaataaactacctcaagataaataccaaaatacaacaatatccaattttatataataaacaatctttctgttaaaacattctctttataaatataatacaattctgttgactttgacattacttaatttcattatacttttgcctcactattaaaaccagatatcattagacttctctgataatttgtaggttgtctttctaaaattaaaccaatggtcaaagtagaattgtttccattatactgatatgaagcaataatgtaggttaagagctcagtaagaaggccagatatactgatattgaaaagcttacaggacagtctccatagcaacctcgtgcatattattttattagtttcttacaaaaaacgtatacctgaaaagtactatggaaatggtgaccccaaatgtctgactttcccaaggccacagttagaatgtaactgaacccagttagaacttgatattcttttgaaagctatgctaggaggctggataagtccacaggagaattcataatatcctgtctaattgccatatctatgcttgatttgggtaagaaaattctggaagagaacccattgacaaaaggcgtacagaacctatcaattaacactttgttaaaacctttaccttcctacataaaatcgtagacttttaaacatgaggatacatagaggccatttatttcaacatgcttgacaaaataagagctcaaaatctatctctgataagatgtagtttttctagttgtctatcttgcacatgaatatttacctgtgctaaaaagatagtccattccacttttagacaacactaattgttagaaattttaccttatgttaattgaaatctacctccctgggactttaaatgctcaaaggcaatcagattttcctttactgtagcttttttttttgtatttttttaaattttattattattatactttaagttttagggtacatgtgcacaacgtgcaggtttgttacatatgtttactgtagttttactctgctgtgcttcaaatcctttctgaccacatttgttgtacccttttcaatttgaagatgaatctccttgggagagaagaaagaagcaaaatcaaaattgagtggctttactttctctctgtcattgaataacatcttcttcaagcaggagggctatttttttcttattatccttattcgcacatagctttttaaaaagtttgctgttcccagtactcttcaataggtcaaggagtctccaaatatttgtgcacggccattattttggtatcttaagaaaataaaatgactcctctttcatcttctttgagtgatagggttattctttcaatcgcagcaaccagcaatgcttaattgtttgtttgtttgttttttaagtcacactaaacttgaacatgacctgtaactcattttagtggcatcaaattactatctcatgacaagtagtgcaaatgcatttgtgtcctatgcttaccaggcactgtaattcagcccatgctgaatgagctttaggagaaattcatatcctgaccctggtactgtctaaaaactcagtgcctttggcattcatatttatatctcttgaggatgctgatcattaggcacatgtatattttatgacttattgtaattgttgcttcaaacttttcttcacgtgctagaagcttatatatgtagcatttttccctttaattaactagatctcaaattatgttctctttacaggtcgagaacgcattcatcacaatacaagacctgggcaccatttgtattaaacttgcacttagccgtatctgatttaatttccaattcttaataggtatattagcttatatatgaaacacaaggcatgcctaaaacacaaagcatggcatatatagctttgaattgccctgatcaaatagctaatgatctgacactaattctcatatttctttttaaccatggctattttgttttccatttaatatataggaaatgaaaatttgcatttgtatctcagtagatggtttaaaattgactttcatatacatcaaatcctccccaaaccctgtaatataagcagggttggtattgctgacttcaaatcctccccaaaccgtgtgatataagcagggttggtattgctgacttctgtgtttagaaagaaaccaaagcttaaaaactgaaagataaaataaatgaacgaggactctccatcaatcctgttgaaagattttctattattataatagtaattagcactgaaataacactattttcaaggaccattctaagtgctttacatatattaactcatttcttcacaacaatctatgatgtaggttctattattgttattcttattttacagatagagaaactggggcacaaagtcacactgctattaagaactgagttttgaaccaaactattctgtctctagagtccatagccttatttcccatattttcaccttggtaaacatttatcgagaacatgatctgtgcaaaatgctttgttatgtacactgagagctataacaactaacaacatgtttgaagggataaatatgactgtaactttaaaaactgaagctatcgtaaaaatattacagaagcttaaatgttttttcccattggtatgaggtgggaagaaagagccctagtggtcaatctaggaaaccatttgaaggagatatgatttgaagctctttgcaatctgagaagacctttgcagcgtgagaaggactgtgacaggtgggcacctgggcaagagcattgcaataggacagcctacgtagaggcccagggaatgagactgtgggagtgaaaggtgagatttctcatgtggttgaagttgagggtgtaggagtgaggcaggatttagtaacagataaattacgaacatagcctcgagccagattgtggagagccttgaacactaaactgagaagatttgaattccttctatatgcagtctggacccaggaaaggtttttaaggacacgagttacataatcagataaattttagaatggcatctctggcagcaaagtataggcttaattggagagggctggactagagaaaggagaaccagaattggataaagacacaattgtccaggcaagaaagaggcaatgagtgtctgaactaagctagtgaaaatatgagtcaggagccttttaccaaagagaaacttgctcagaaataggataaactagatttggaaactcatgggaaggagaaataggaggttacctcacattttatagtctgaacagtggagaagttgcccctgtagtcacaggagacaaatatatggtcagttttggggattttgtgaaaaagcccagcccatgataatctttcttcttgaattttaacactcagctttgcacagtttggtcctctgcttgtattatgtgtatctcagtgtgtgtgtgtgtgtgtgtgtgtgtgtgtgtgtgtatgtatatatatgttatatatgtgtaatatatatgttatatatgtataatatatatgttatatattatctggcatgtatatatacacacacacatacatctcatatcagatcatctctcataatgtcagtgtgtattgtagctttgactgcctggttaacacgtgaatctactcatcgctgtatcggaaatctctctgatagcccaaatcatctcttactattttcataggtcatgctatttttcctaaaacacaagttaatctttctctcttcttgaatatttaaatattgatataaatttgaatacaattggtaggtaagatcaagggttgggtgattttgatggatgataacaatctagtgaaagtatttttagacatacgagttatgatttttttgcataattcttgcggaagaccgtgtgatagttttctgtgtgtcataaattatttcaaaccctttgcagtttcagtatgaaatatttctaatgaacaactcctttgaattatactagcaacattctatgtggctatttcagaggataatatgtctacatttttgctgtatgtttttgtactcttaaccacatttaaaccattgttaaccttggaacatcctaagatctggccctgtattttttacatcttttaaagaggtgacacaccctttataatgtgcatttttcactttttaaacctaccatttactttttaagacattttgaacgtttatttcatcctattgtgatttttaatttttctccattatcgcttacaatgtttatatataatttatgataataatgtatatttgcaatgcatataattcacctttttgccaattgatcttcattaagtcagtcaacaagagaagcttaataatgttcatgtcctttaagatgctatttaccttcatggttcagtctataaaaattgggtccaagacaaaggaacacactccagattagtcagacaatcctagcaattgttttgtcaattctattattattcatatgttgcttacttttattgagtctttctctaccctttcctttctgagccctaaaataatacttgctgccccattgacttcaggcttggcaacacagctcgtttggccaatgaaatgtaagtagacataacatgttgctctttaagcagatctttgagttattgtctgatttcctccaacttttttgtcctatctttctgtaggctagcacatcacagatagaggctgcgacttcagccttgatctcaaaataaagtgcacctggagcagaacctcagtcaatatgtacccatacaatgtagtgaaatataaacctttgtttttgtgagttactgagacttggaacttatttgttaattgcactacatttagcttaaactaatgcaaataactttctgcatattttattcttgtttggtgtagatcattgtagacattttccctacatattttctgaaaaatttagtatatttttattaaatggtatagtattataaaataattgttgtaaactttaaaaagtctttattctggttaacagtgtattgtgagcattaaaccagatgactaaatgtatacttgcctctttaatgatttaatagtgttctgtttatggaaagtggcatagtgtagtggttaagagtacagtctctgggacataaatttctgggttcaagtcactgttctaccacttactagctgtgtgaccataagatactaaatttatttgtgaccttaagtaagagacttatttatcctatgaaatagtaatccaatcccttattttgttaaataaatgactttttctattataaaaatatggtaaataatatcatgggtgccaccctctccctcatcctcacttctggcttacctcaatttctcatgagcctttattattattacttttaaataactttcataactttttaatgattgccattctaactggagtgagatggtatctcattgtggttttgatttgcatttctctaatgaccagtgatgatgagctttttttcatatgtttgttggccacataaatggaaggggaacatcacaaacccagggcctgtcggtgggtcgggggaagggggagggagagcattaggacaaataccaaatgcatacggtgcttaaaatctagatgacgggttgataggtgcagcaaaccaccacagcacatgtatacctaacctgcacgttcagcacatgcatcccagaacttaaagtaaaattttaaaaaatgtatatatataaaataccttttatattcctctttatatctagtactaccacaactactttaataaaaaatattaatactttgatctcttacctgaagtgttagtctacttttatcactcttatcatactttaatctgctctccatactgtagccagaatgacttttccaaatcgtaaacctcatcattcattcatcttcttaaaactctccaatggtttccattttctcttagaataaaggaaaaatttcttaccaagtcttaattattttcttagtctggtctctgcccctccaccttcatattttccatattccatcatgctgtctgtgctccatttctgaaaaattacaaaaaagaaaaaaaatcaaattatatatattagattaatcaggactccatagaaaaacataagcaatagtatatagagtcatgcattacttaatgatggggatatgttctgagaaaggcattgttagatggtgtccttgtttgaagatcatagagagcgcttacacaaacctagatggtatagcctactacacgcctagactatatggtatagcctattgcttctaaactataaacctgtacaacatgttactttaccaaaccctgtgggcaattgtaacacaatgctaaatagttgtatatctcaatgcagaaaaggcatagtaaaaatacaatcttataatcttatgggaccactgtcctatatgcagtctgctgctgacctaaatgtcattatgtgatgcatgactgtgtatgtgtgtatgtctgtctctgtgtgtgtgtctgtcaaaagagatttattataagaaattagaaattggctcatgcaattatgaagggtgagaagtctcaggatctgcagctggtaagctggagacccaggagaggcagtgctatagttctagtctgagtccaaaggcctgagaaccaagaaaattgatgttgtaagttccagtccaagagcaagagaagattgatgtcccagcctgatcagtgaggcagagagggcaaattttctcttaccttgccttatgttctattcaggccttcaatggattggttgaggcccacccacattgagaagggccatctgttttacttagtctacggattaaaatatatgtcttaaccagtgcttgcttcggcagcacatatacaaatatatatcttgtccagaaacaccttcacagacatgcccagaataatgcttttcatttgtttttgtttcttattatttttaatttttgcaggtacatagtaagtgtatatatttatagagcatatggaatattttgataccagcatagaatgcataataatcacatcgggtaaatggggtatccatcacctcaagcatttatcctttctttgtgttgtagacaatccaataatagttatttttaaatgtgttatttaaaaattattattgactgtagtcaccctgttgtgctatcaaatactagagcttattcattctatctaattatatttttgtacccattaaccatccccactccacccaccactctcagcctctgataaccatcattctgttctctatctccatgagtttaattgttttatttttcagctcccacaaataagtgaaaacgtgtgatgtttgtcattctgtgcctggcttatttcacttaacataatgacctccagttccatccatattgttgcaaatgacaggatttcattcttttttgtggctgagcagcactcccttgagtatatgtaccacattttcttatccattcatctgttgatggacatttaggttgcttccctatcttatgaatagtgctactgttatggatagtgctacaatctatgtgggagtgcagatatctcttcgataaactgatttcctttcttttgggtatttacccagccgcaggattgctgaatcatatggcagttttattttagtttttttgaggaacctccatacttttttccatagtggctgcactcatgtacattcccaccaacagcatctaaatgttcccttttctccacatcctcatcagcatttgttattgcctgactttgaaataaaagccattttaaaactggcatgaaatgacatctcattgtagttttgatcgcatttctctgatgatcagtgattttgagcaccttttaatgtacctgtttgccatttgtatgtcttcttttgagaattgtctattcagatctttagcccattttaaatcagattattaaactttttcctatagagttgcttgagctccttatatattttggtgattactcccttgtcagatggaaagtttgcagatattttctctcattctgtgggttgtctcttcactttgttgtttgttacatttgctgtgcagaagctttttaacttgatgtgatctcatttgtccattttttgctgtggttgcctatgcttgtggtgtattactcaagaaatctttgcccagaataatgttctggagatattcccctacattttcttgtaggaatttcatagtttgaagtctcagatttaagtctttaatccattttgatttgatttttgtatatggtgagagataggggtctagtttaattcttttgcctatggatatccagttttcccagcaccatttattaaagagaatgttctttcaccagtgtatgttcttggcatctgtgtcaaaattgggttcactgaaggtatatgaatttatttctgggttgtctattctgttccattggtctatgtgtctgactttatgccagtacaatactgttttgcttactatagctctgtagtataattggaaatcgagtaatgtgattcctccagttttgttctttttgcttacatccagaataatgtttataaaatatctgggcaccaccagacacactaaaattaatgatcacagtatactaaatttggaatataataatttatattaggtctttgtcattatagaaaaaatttactgaaatgaacaattttggaggaagtataaattaccaaataaaagcaagaagaaataggaaacaaaaatctaacaatgtccatgaagaaaaattttttaatatttcaaataattacttcaaaaactagtcctaggatttaccagtgatttatttcatgtttaagaaactgaaaatttatttgccatttgtttttagaatattaaaaattacagaaagttatataatgtgtcttataaaaccaacataaatctgaggccaaaatctgacatagagagcaaaagaggacattccaatacctgtgaggataatcagaattttctctctctctctctctctttctgtgtgtgtgtgtgtgtgtgtgtgtgtgtgtatgcctagtttgaaaaagttttttcattcaggagattcctctatatatttattatcacaattaatgtgttcctgccttgtgaacagtggtttagaaatataaatatatattcaaaacctcaaaatactaataaataagatttaaaagtattttcaggcttccacttctttctaagagtgactaataagcactggatttactgtccaacctgaaacaattgaaaaaacagaaaaaaaaaaaaaaaagaaacaatggctttcaagacactggacatcagccagtgaagaccagtgttttagtttggtagggctgctatgtcaaaataccacaaaattggtggcttaagtaacaaaaatgtgttatctcccatttctggagactagaaatccaagatcaggttgtcggcaaggttgcttcctctgaggactgtgagaaagactctgccccatgcctctcacctagcctctggtgctttgctggcaatctttggtgctcactgatttctaggagcatcactctgatctctgctttcatcttcatatgatgttctctgtatgcgtctgtctccaaatgtctcttttttttttttaaagaacatccatcatattggattagaagcccaagctacgctagcatgaccttgttttaactgaactaattagtactgcaacaatcctatttctaaataaggtcacattgtgaactataggggttagaactgcaacaaaagaatgttaggggacacaattcaacccataattgatagtgatccctgtggattgagacattaactaaagaagtcctatgatggctccaagttacttcctgaagagaatttccttctcacagagcagaaagagaaaacctaagtgaaggtcagtgatctccctgacttgagacaaagctggaagtccacgtgggccaaggtggctagagtggtcaggacagagtcttagaaaggagacagtagcagaaagaggaaactccagagcttcctctgagttttcagctgagcgccgatcaaggtatgggtgtgaggaaagtaccccaggccacagaaagaaccattctgaatgactgaaggaaacagttcttgaagatctcacagggtcaggaattgttcctcttcccatcagccagaggagaaagccttcatacatggagcactggttaaagtacctagaagtgtttttccttagtgatggggaaagattagccttaaactaaacactgctgtgaccccacctaacaatgctttaaagcagaacctaaatggctcaaacattttataagtaacttctttaaatctcagaacaaagctcaagaatatttatagaaatacagaaacatatagcacccaaagaggcaaaattgaccagatctagcatccaataaaaaaaattaccatgcatgcaaaaaagcaggagaatccaacccacaattaggagaaaaatcaattgataccaacccagaatgacactgatgataaaattagtagacaaagacattaaaacaattattataactaaattccatatattccaaaaataacaggaagatttcacatgttatacagacatgtgaaaaacctaaggatctaaattgaacttctacagtgaaaaactacaatgactaattattaaaaataacatttatgggattaatggcaaattagactttgcagaaaataagataagcagacataaatcatagaaactataaaaaatgaagcatggagagtaacaaactaaaaatatatttgaagaaataatggtccaaacttttcaattttgacaaaactattaatattctaaaagaaaacataggagatttcttaattaggacacaaaaaatgtagtccatacaagaaaaaagaaatagattggactttctaaaaattaaaaacttatgttatttgaaaggaactattaggagaatgaaaagaaaagccactgactgggagaaaatatttgcaaatcacatattggataaaggaattgtatcaagaatatataaacaccaaactgggaaaaaggtccttgcaaaccaaaaatctgataaacagttaatatctaaaatttataaagaactcttacaacctcaatagcagaaaaacaaataactcgatttaaaagtgggcaaaggacctgactagacatttctccaaagaatacataaaaatggcccgcgagtaaatgaaaaagtgtgcaacatcactaatcatgaaggaaatgcaaattaaaaccactgtgagatatcaccctgtatccttaaggatagctattatcaaaaggtcaaaagataaatgttggtgtgggtgtggagaaaaaggaaccctagtacactgataggaggaatgtagattggtacagccattatgggaaacggtatggaggttcttaaagaaatttaaaatagagcgaccatatgacccagaaatccctctctgagtatacacgaaggagatgaaatcactacctcataaagacatctgcactcccatgttcattgcagcattattcacaatagctgagatatggaaacaatctaaatggccatcaatggatgaatggataaagacaatgtgaggcatatttaccacaacatgaacggacctgggggatgttaagctaagtgaagtaagccaaacacagaaaggaaaatattgcatgatctcacttatatgtggaattaaacgaaaacagagagctcaaatacacagagatagaagatgaaacagtggctaccatggtgggcagaggagagaggaaatgggaagattataggtcaaagggtacaaaatagcagacacgtaggataaagaagtcgagatctaacgtataacataaggactaaagttaacaaaattgtattgtattaaagatttttgttaagcaagtatattttagcagctcttgtcacaaaaaagtatgtgagatggtagatatgttgacagcaaatctacatatagacaccattagctttcctagcacaaataaaaacagaactatatgatgatctcagtatatgttaaaaagcatgaaacatttaataaaagtcaaaagctattctttaatttaaaaaactcttagaaattagtaaaaagaaaaaaagaaacattaacatcagaaagactatcagacaacatattccctgctagtgaaacactaaccatctttcattaaaataagtaggacaaagatgccatcatttacaccagtactggagctaaaaggcgtccctcttggaaagatagataaatagactctgctgtttggaataccctgagttatgaataaaatggtcttcagaagctgctcagaatgccttcctgaactattccattttattcttcgtgctatcaactaagcataatgcttcctttgactatgagttgtgagtcattttccattcatgctctaaatctttggaactaataatgattttctatacatcagtaagtacacattgatttgcttctcttccccagatggggaggttgtattgagttggtccatgtaacaggagtcccatgtccctgggacagagacagaaatgcctctcggtctcctgaggctgtagttgttcggattaaaggaggaaagaaggaagtatcaggctgaatcctggctaaggatggaatcctgggaagcatgactgagtgttctttacatctgggaaggcctggagttgttctttcaactaggaagagccaggtgaaagagataagagggatgatcactaaaggaatgttgtttgctcagatggaatctaatccaaggccaattatttgagcaaaacagttccaaattcactcagaaagcttcctgttataacacgtttacattcatctcaggtatgctcagggttcataagttcattgcttatccatattaaaatattgcagggagtgtgagtgaccaccagaaaagttaactaaaggaatatatcagctactctgatggacaatttgaaaacaagaagaaaaatatgcactattaatcaatgttttcagaagtatctaatttagtctggcagcagaacaagggaattcaaaagaaaaatggaattttgttggagggggtcaaagtagaaatgtttcttaagtgttacagtgtgaaaacagagaaatgttaaacttgatgctgtcatacaaataactttgacctcaaaaagccagaaactttgaagaaatcttgatgagtcctacagattctatcatcacctacatatagatctcgatgccaaatctcaaggcagggtacccagcagagagcttctgggacatgtgtccactggggctgcagcaaagtttgtgttacataacactgctggggagattaagcacacagcgaggagggtagcagaactgtagtcactgctgtgaatactctccattaatcaatcgatcaacccacaggtagatcccgagcacctcacctgtgtacaggaaccagacttgcacaagttcgccaaagtgtttcacagaaaaacctaaaaccagctttggcttatgagtttggacagcaaagggcgagaaaaagaaaattgttgggaagaggcagagttaccaatagaaataattaccccagcctctaacagaaaaataacccttatatgcaacttgtgtaggaagtatttaggattcaatattgtaaatagaaatcaccatgtaaattcaaatgcaaagaaaaatattaatttattttattatacaatcgggtcattctacatgtgcaagacacaacgcagttttatactctgtataatttttttttttgagatggagtctcgctgtgtcacccaggctggagtgcagtggtgcaatcttggctcactgcaagctccgcctcccaggttcacgccattctcctgcctcagcctcctgagtagctgggaccacaggcgcctgccaccacgcctggctaattttttgtattttagtagagatggggtttcaccgtattaaccaggatggtctcgatctcctgacctcgtgatctgcccggctcggcctcccaaagtgacaaatatttttaaagacctagaatttggcctgactttctgtataatgtgatattttctagctctgtctttaaatggaattaaacttcttagggatgtttgatttagctctgagcagatttgttataactctgaggattttttctagctgatttttcttaagttctcatgttgagggttcctgtgaactcaaaggcccaaactctgttcaaatacacaccaagggaaatcttgccactgatgacacagtaagtaaaaggtgccaagggagagattctggctaagactatttcttctgtgagagaggacagagtctgtgtcagttatgatggcaactgttggataaaaagcaacacttttacaacagaaatctttttttaaacaatcaaatgtcatggctgcctgcactttctgtatgtgttgtgagcagtcatctaattccaaaacagccctaagcgtatgtcaaatcagtctacaagtttcctacctgtcttcattaggtttttctgatttgtctttgaatttgctggaaactcaatatgggaaagaaattgtgtaggacatcttttaattttttattccttggctcacaccctctgtcactgcagccaccacttttactcaggtgaggcttgacagtcccttgtctcagctgcacagagcatctcttttttccaaccttggggttcctctgccactatctgtgtgtctcctgtaaacttgctatgatggttaatactgcgtgtcaacttgattggactgaaggatacaaagtattgatcctaggtgtgtctgtgagggtgttgccaaaggagattaacatttgagtcagtgggctcggaaaggcagacccaaccttaacccgtgtggtcacgatctaatcagctgccagtccagctagaatataaacaggcagaaaaatgtgaaaggaaagactggcctagccccccagcctatgtccttctcccatgctggatgcttcctgccctcgaacatcggactccaagttcgtcagtttgggaactcggactggctcttcttgctcttcagcctgcagacggcctattgtgggaccttgtgattgtgtgagttaatacttaataaactcccatatatatatatgtgtgtgtgtgtgtatacacatatatatacatacacatacacatatattatatatatatatgtattgcattggttctgtaccgctagagaaccctgacttgcccagacattctcacacaggtgcaaaatggaagggcaaagacatacttaacatacttggatgggtgaccattgactaatgtaggacagtaactgattgataaattttcctctcttgagaactccttgtctcaggcaggcagttctgtggctttgtctgcatgcttccttagagtttacaggcagagctgtgttcaacatttgtagccttggagtggttttccttccttctctgtctcaaacttcccttctctcacttctattccctgggatttcttcccaaaataaactacctgtacatacacaaggtctcttctcaggttctgcttttaggggaattaagagagcaactaagtattttagtagctatttggttgttttaatatgcctttgtgacaaaccagtaggtcatacaagtatgacctactggtttgtcgatggctcggtacagtggctcactcctgtaatcctagcatatttcaagatggctattcagagggctggaaatacaagaatggctgaaaagcgttcacagacagcaacaaacaggagttgtgggtgtttccaacaaaaaaacaaacttgggttacttgaagccactaaatttgtggtaatctgtttcagcagcaataggagactaatacaccagcctggccccagtccccagatgatacacacggctgttggctagtagaattccagtggtattttatgtttttaacagttttgaaaagcatgttttttatatgaagcatcttttccaccctgtttcctccacatctcaaatgtccttgtccaattaaatgcaagctgtcataataaagaaaaacagtttgaaatctttaagattcccagtcaaaagagagactcataattatatataagtgaatgcagaatctattctaatggaaagatttggagatttcatacacacatgcacatacatatctatgtatacacatacaaatcaatatatattccagtacatgtagtacatattagagaatacgaacatatatgcatatgcatgctttagtttgtatgtgtatatgtgtatatatatgtatatttgtgtacatctatttgtatatctgtatctatatatcttcaactaagaggaaaaaagccaagccaaagataatcaacttccatatagcgccatgctaccaataactttttttcaaatactatttctagaaggcaatttgtcagtacctattaaatatgaaaatgtgtacctcttctggcctaacaattcactgttcaggaatttaatctaaagaaatactttaaaaaatgtgtaaagatatatgtatatatttaatattaattgcagtatgttgttttctaaaaaataaaatgaaacatatctgtcattatttaaataggttttagtttattcattaaatgcaaagagtgagattaggatgtatgggcaccaaagcatatccatgaaatattgggtgaaaaaaggaagttttagattaaaatatagaagataaaccataaaaatacatgcattttgatgtaaaggttttcttaggagcataattactttaaatatatatatatttaaaacacaaagagatggtgctatcatcaagatcagaagacaaaaaaacttaagtcagtggattttagtttccatttccagagttaaagtcatatacatgctgtactctatttctctgtatgtatgtttttttctctctcttttctaaaggagagaaaatatagatctttttgcattgtggagtttgggaaacggttaagtctctgagtacttctgagcattttaatctgttgatctcaccaaaggtcatcaattaatgctttttatttataaataacttctgttctttgtttttgagctcaaaatttaagaataaaatcaaacttttttgaggaggttgggattcaaagtgttaaggacttttactaagtaaatgattatttgtttctttttccattttaagtgagtttccatttataggtgaattacttccttatgcaagccagcttttaaagcaactatttaaacgaaaatagataaataaaatttttgaattttttttccagaaagaaaagaggaaacatgaatggagttatactgtgtgccagcctttgtcctagtgacttaaaaatggtataacatttaatgttcatgaatgcctattgagctggaatcatttcttagatctttccgaggagacacagggtccatgaagcacagggtcactttgccacacattcatttttttaattttaattaattaattaattaattaattaattaattaattttgaggcagagtttcactctgttgcccaggctggagtgcagcggtgtgatctcggctcactgaaacctctacctcccaggttcaagcgattctcctgccccagcctcctgagcagctgggactacaggcacctggcaccacactcaggtaaacattcagacatagaactcattactcttttctgtaacatggaacataaaatattctatggttttatgtaggctattagtggaattatttttcttaagcctatgttggctaaacccgatcacttatcttgggcaagtcctgttggtaatgtactaacacagaaagtgcagctatttagaacatctaaaatgataacttatgaaactgtattgctctaaaaaagaagaggataatttaaaatgtataccttgaacatttttctcttgaagactattattagacatttaatcttagatgctaggagattagagctttctatatctttttgccaaatctatatctgtcaaaatctgactttaggcatataccattaacataaattgatatttttggacaaagcttacattataacagatctttctaatactaagtaagcctccagatattttgctgtttagtttggatcttacatttgttctgtagttggataaatacatacctgaaatttagcaaggagtatgtaaacacttgataatattattagtgtgatatgaataatagcattgctccttctgtaagaactaaatgcccacatttatcagagttactacctaatattagagctagaatcacctaaagagattaaacaacaggagaaaaaaaccctgctctcaaggatttcacagtttggtgggagaaaaccttttccattaaaacagcaccctacttcagtgcctagtatatgctaggtgttattggggttaccttcaaatttgctcatttggtcttcataataacctgcctttggagggggattttcctcccccaagaatgtgcttgctttttggtcctttggaaactcctattcatccttcagaatttgttgagatagcttctttatgaattcttttggccaggtgctgtgactcgctcctgtaatctcagctactggggaggctgagatgggacgatcatttgagcccaggcatttgagaccagcctgagccacatagcaagaccctgcctctaaaaaagtaaaataaaataaatgaattctaccttggcctgcctcctctcagctgtcccctataggattaatcttcccatctcttaatgatttctgcatatatttctataacagaaatcaccttgagctgaaatttcatggttatctctctgtgacacaacagtgagatcctttgaggaagaggattttgtcctattttgctcattcaagtcaaccccaacactgttctactggatgatccattcaaatcttgaaaggcgaacgtctccccctcacggacagtaccggaattcaacaagtgaaagttcaattttattctaggaagcttctctagtgaggcagatttgccagtgtctgtatctttgtcaatcttcacggcaatcttctgaagtcatccctttgctttcttgcatcctccactagacagttgggtgagagatgactcttatttgattctctctctatctaaatagtaactgaagcctgtggacagtctataagtgtttaccaaaataaatcctccttaccctactccattttttaaaaatcaactttatttaggcataatctacatacaataaaatccacacatttcacacgcaccggttgatgactcaataaatatatacttctgtacattcattactcaaatcaaaatataaaatacttccatttccccaggaaattccctcatgcccttttgtagttaatctcccccattcagctgccactccagagatgagaatctccttttgttgcagtagtatagttttgcctattctacatattcatgaaaaattgaatctcatgatatgtactcttttgtgtctggcttcttttattcaattcgatgtctgtgaggttcatctatgttttgcaaaaggaagtaatgtattcttttttactgctgaatagtattttactgtctgaatatatgacagtttctttaaccattcacccattaatgacatttgaattgtacccagcttggctactatgaacaaagatgccatgagtattcatgtacaagttgttgttttttgtttgtgtttgtgtttgtttttgttttgttttgttttgtttttttagatggagtttctctctttgttgcccaagctggagtgcagtggcatgatctcggatcttggctcactacaacctctgcctcccgggttcaagtgattctcctgtatcagcttcccaagtagctgggattacaggtgcctaccaccacgcctggctaatttttgtatttttagtagagatggggtttcaccatgtcagccagggtggtctctaactcctaacctcaggtgatccacctgccttggcctcccaaagtgctgggattacaggcgtgagccactgcacctgacctcatgtacaagttttttaaaaatggatatttgtaacttttctcttgggcaaatacctgccagttagtaacttaatatggtaactatatgtttaattttatatgaatatgaaactgcaacgtgttttaaacatatctgcagtattttacactcccatcagcaatgtagaagtttcagaagctcactgtcagtcctttttcccactgctgataaagacatacctgagactgggaagaaaaagaggtttaattggacttacagttacacatggctggggaggcctcagagtcatggcgggaggtgaaaggtgcttcttacatgatggtggcaagagaaaatgaggaagatgcaaaagcagaaacccctgataaacccatcagatctcatgagacttattcactaccatgaggacagcatgggggaagccgcccacatgattcaaattatctcccacctggtccttcccacaacacatgggaattatgggagtataattcaaaatgagatttgggtggggacacagagccaaaccatatcattccacccctggcccctccaaatctcttattgtcacattttgaaaccaattataccttcccaacagtccctcaaagtctaaactcaattcagcagtaacccaaaagtccacagtccaaagcctcgtctgggacaaggcaagtcccttccacctatgagcctgtaacatcaaaagcaagctagttacttcctagatacaatgggggtacaggtaatgggtaaatacagccatcctaaatggtagaaattggccaaaacaaagggattacaggctccatgcaagtccaaaatccagcagggcagtcaaattctaaagctccaaaatgatatcctttgattccatgtctcacatccaagtcacgctgatgcaagaggtagattcccatagtcttgggaatctccacccctgaagctttgcagagtataacgcccctcctggctgctttcatgtgctggcattgagtgtctgcagcttttccaggcacatggcacaagctgttggtggatctacgattctggggtctggaggacagtggccctcttctcacagctccactagacagtaccccagtagggaatctgtgtaggggctctgatcccacatttccctccaacattgccctagcagagttctccatgagggccctactcttgcagcaaacttttgcctgggcatccaggtgtttccatacatcttctgaaatctaggtggagtttcccaaacctcaattcttgacttctgtgcactcgcaggcacagtaccacgtagaagctgccaaggcttggggcttgcaccctctgaaaccatgggccaagctgtaccttggtctcttttagcaatggctggagtagctgggacacatggcaccaagtccctaggctgcacaccacatgaggaccctgggcctggtccatgaaaccattttttcctcctaggcttccaggtctgtgatgggaggggctgccatgaagacctatgacatgccctggagacattttctccattgtcttggtgattaacatccttgttacttatgtaaatttctgcagccagcttgaatttctcctcaaaaaattggtctttttcttttcttttctgctccattgtcaggctgcaaattttccaaacttttgtgctctgttttaaaatggaatgcttttatcagcacccaagtcacctcttgaatgctttgctgcttagaaatttcttctgccagataccctaaatcatctctctcaagttcaaagttccacaaatctctagggcaggggcaaaatactaagagtctctttgtaaaacataacaagagttacctttcctccaattcccaacaagttcctcatctccatctgagaccacctcagcctggaccttatcattaatatcactatcagcatttctgttaaagccattcaataaatctctaggaggttccaagctttcccacattttcctgttttcttatgagccctccaaactgttccaaactctgcctgttacccagttccaaagttgcttccacattttcagatatcttttcagcaacactccactctactgttaccaatttactgtattaatccattttcacactgctgataaagatatacataagactgggaagaaaaaggggtttaattgaacttacaattccacatggctggggaggcctcagagtcatggcggaaggtgaaaggcacttcttacgtggtggcggcaaaagaaaatgaggaagatgcaaaagcagaaacccctgataaacccatcagatctcgtatgacttattcactaccatgagaacagtatggggaaatggcccccatgattcaactatctcccactgggtccctcccacaacccatgagaattatgggagtacaattcaagatgagatttgggtggggacatagggccaaaccatatcattcactaaaagtttggtattattaggctttctaattttaaccattctagtgggagtatagtggtatctcattgtggtttttagttttccctaatatctaatgatgttgagcatctttttatgtattactagccatttatgtatattcttttgtctattttaaaattgggttgtcttattattgagttgtaatagttctttatttattcatcgtatatatgtgtctttaatcatatatatgtgttccaatattttctcttttatttcatacatgtgttttatcatatacatgtattccaatgttttctcctagtcaacagctggctttttattttttgacagtgtctttgaagaccagaaagtttttattttaaaaaagttcaatttttcctttatgattagtattgtttgtgtcttatctaaaaaaaaactctgcatatatcaagattaaaagattttttttgttttcctctagaagtgttatagttttagctttaataatcaggtttattattacattttaaattaattgttttgcatggtgttagataagcattatgttttatttttcttcttcttctttttttttttttttgagatggagtctcactttgtcacccaggctggagtgcagtggcgcaatctcagctcattgcaagctccgcctcccaggttcatgccattctcctgcctcccaggtttacaccattctcctgcctcagcctcccaccattctcctgcctcagcctcccaagcagttgggactacaggcacctgccaccatgcccggctacttttttttttcttgtatttttggcagagatggggtttcaccatgctagcaagaatgggctcgatctcttgaccttgtgatccacctgcctcagcctccattacaggcatgagccactgcgcctgaccttattattcttcttatacaaatatccagttgcttcaatatcatttattgaaagaagtatcctttccttatgagattgcattgctgcccatgcaaattatcaattggccattatgtgtgagtctacttcaggactttctattccattgatctatgtgcttatatttaactttaccacactgtgttgattaatgtacttttttactacacattgaaactgccaactttgttttctttttcaaaattatttctctgttctggtccttcacatttccaagtaaatttttgaattattatgtcaatttttacaaaagtcttctggaaatttgaccagaattaagttaaatttgtagatcaacctagggagaataaacatcttaacaatatcaggtcttctaatccatgaacaaggtagacctctctcaatttacttatatcttctttagtttctatccatagtgttttatggttttcagttttctctgaatctatcatgatatatcattttcccccatttttctcttaatatgatgaatacattgaatttcttttgctagcctcatcttgctttcttggtataaagcttactaagttatgatgtattatgatttttacatattatgggatttaatttgctaaaattttgttaaggatttttgcttcaagactcataagggactttaatctgtaatttcatctcttgtgctatttatgtctggttttgatattagaaccttgtaaaatgagttctgaaacgttctgtccttgtcttgtttctgaaaatgtttgtataggattgctaccaactcttccataatgtcttgagttatgattgagttagcaaatgaaaaaatctgtgcctttaagtttcatcattatgataggacttactacaaattcagtttctgaataggctttctattttctcttgtaacttttgattatttagaatttttttaatttttttaatttattattattatactttaagttttagggtacatgtacacaatgtacaggttagttacgtatgtatacatgtgccatgctggtatgctgcacccaccaactcgtcatctagcgttaggtatatctcccaatgctattcctccccctccccccatcccacaacagtccccagagtgtgatgttccccttcctgtgtccatgtgttctcattgttcaattcccatctatgagtgagaacatgcagtgtttggttttttgttcttgggatagtttactgagaatgatgatttccaatttcatccatgtccctacaaaggacacgaactcatcattttttatggctgcgtagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccattctaagtggtgtgagacggtatctcattgtggttttgatttgcatttctctgatggccagtgatgctgagcattttttcatgtgttttttggctgcataaatgtcttcttttgagaagtgtctgttcatgtccgtcgcccactttttgatggggttgtttttttcttgtaaatttgtttgagttcattgtagattctggatatcagccctttgtcagatgagtaggttgcaaaaattttctcccattttgtaggttgcctgttcactctgatggcagtttcttttgctgtgcagaagctctttagtttaattagatcccatttgtcagttttggctcttgttgccattgcttttggtgttttagacatgaagtccttacccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcgtgtttgtcaaagatcagatagttgtagatatgcagcgttatttctgagggctctgttctgttccattgatctatatctctgttttggtaccagtaccatgctgttttggtaccagtaccatgctgttttggttactgtagccttgtagtatagtttgaagtcaggtaatgtgatggctccagctttgttcttttggcttagggttgacttggcgatgcgggctcttttttggtcccatatgaactttaaagtagttttttccaattctatgaagaaagtcattggtagcttgatggggatggcattgaatctataaattaccttgggcagtatggccattttcacgatattgattcttcctacccatgagcatggaatgttcttccatttgtttgtatcctcctttatttccttgagcagtggtttgtagttctccttgaagaggtccttcacatcccttgtaagttggattcctaggtattttattctctttgaaacaattgtgaatgggagttcactcattatttggctctctgtttgtctgttattggtgtataagaatgcttgtgatttttgtacattgattttgtatcctgagactttgctgaagttgcttatcagcttaaggagattttggctgagacagtggggttttctagatatacaatcatgtcatctgcaaagagggacaatttgacttccccttttcctaattgaatgccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtctgtcatagatagctcttattattttgaaatacgtcccatcaatacctaatgtattgagagtttttagcatgaagcattgttgaattttgtcaaaggccttttctgcatctattgagataatcatgtggtttttgtctttggttcggtttatatgctggattacattcattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagattctgttattggtctattcagagattcaacttcttcctggtttagtcttgggagagtgtatgtgtcgaggaatttgtgcatttcttctagattttctagtttatttgcgtagaggtgtttatagtattctccgatggtagtttgtatttctgtgggatcggtggtgatatcccctttatcattttttgttgcatctatttgattcttctctctttttttctttattagtcttgctagtggtctatcaattttgttgatcctttcaaaaaaccagctcctggattcattaattttttgaaggatttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttctttatgtacccagtagtcattcaggagcaggttgttcagtttccatgtagttgagtggttttgagtgagattcttaatcctaagttctagtttgattgcactgtggtctgagagataatttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcacagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgagtctgggtgctcctgtattgggtgcatatatatttaggatagttagctcttcttgttgaattgatccctttaccattatgtaatggccttttttgtctcttttgatctttgttggtttcaagtctgttttatcagagactaggattgcaacccctgtctttttttgtattccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctctttagttgatgcagtttcttcctagtctcgatggtctttacgttttggcatgattttgcagcggctggtaccggttgttcctttccatgtttagcacttccttcaggagctcttgtagggcaggcctggtggtgacaaaatctctcagcatttgcttgtctgtaaagtattttatttctccttcacttatgaagcttagtttggctggatatgaaattctgggttgaaaattcttgtctttaagaatgttgaatattggcccccactctcttctggcttgtagagtttctgccgagagatccactgttagtctgatgggcttcgctttgtgggtaacccgacctttctctctggctgcccttaacattttttccttcatttcaactttggtaaatctgacaattatgtgtcttggagttgctcttcttgaggagtatctttgtggcgttctctgtatttcctgaatctgaatgttggcctgccttgctagattggggaagttctcctggataatatcctgcagagtgttttccagcttggttccattctgcccgtcactttcaggtacaccaatcagatgtagatttggtcttttcacatagtcccatatttcttggaggctttgctcatttctttttattcttttttctctaaacttcccttcttgcttcacttcattcatttcatcttccatcgctgataccgtttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggcttgaatgtcctcccgtagcttggagtaatttgattgtctgaagccttctctcagcacgtcaaagtcattctccgcccagctttgttccattgctggtgaggaactgctttcctttggaggaggagaggtgctctgctttttagagtttccagtttttctgctctgttttttccccatctttgtggttttatctacttttggtctttgatgatggtgatgtacagatgggtttttggtgtggatgtcctttctatttgttagttttccttctaacagacaggactctcagctgcaggtctgttggagtaccctgccgtgtgaggtgtcagtgtgcccctgctggggggtgcctcccagttaggctgcttgggggtcaggggtcagggacccacttgaggaggcagtctgcccattctcagatctccagctgcgtgctgggagaaccactgctctattcaaagctgtcagacagggacatttaagtctgcagagtttactgctgtctttttgtttgtctgtgccctgtccccagaggtggagcctacagaggcaggcaggcctccttgagctgtggtgggctccacccagttcgagcttcccagctgctttgtttacctaagcaagcctgggcaatggcgggcgctcctcccccagcctcgctgccaccttgctgtttgatctcagactgctgtggtagcaatcagtgagactccgtgggcgtaggaccctcccagccaggtgcgggatataatctcgtggtgtgccgttttttaagccggtcggaaaagcgcagtattcgggtgggagtgacccgattttccaggtgcgtccatcacccctttctttgactcggaaagggaactccctgaccccttgcgcttcccaagtgaggcaatgccttgccctgcttcagctcgcacacggtgcgcgcgcccactgacctgcgcccactgtctggcactccctagtgagatgaacccggtacctcagatggaaatgcagaaatcacccgtcttctgcgtcactcactctgggagctgtagaccggagctgttcctattcggccatgttggctcctcccgattatttataaatttttaaaaatttatacattttatctaagttgtcaaatttatttacataaagttcacaatgtttccttattattttaagattggtgagattagtagtgtccttttatttctgatattggtatgtgatttttatctctcattttcttggttactcttattgtgtcatttttttcaaaacactaactatggctttattttatgtattgtttatctgtcttctattttactgatttctgcttttatctttattatttgtttcttctacttatgttcagtttaccatttactttccatttacttgtttgcttcttaaagttaaatattaaatcattaattttgacctttcttccttaatatagacaatgatgtctgaaaaataccttctaagccatgctttataagcatcccagaaacttaaacacattgtgtttttattattattcagctcaaaatacttctttatttctcttgcaacttctttaatccagtgtgtgttatacaaagtccaaatatttgaggctttctgccatattttactgatgtctaattcaatttctttgcaggcagtggacataatctgaaatcattcaataaaatgtactgagatttatttcatgggccaatgtatgatttattatttcaggtgtaattttgagtttttggatgtaaggcctgtaatgtgcattagatacagttgactgagaagatagtttagatattatattttcttactaatttttgtctacttatcttgagaggtttttaaaatctctctacataaatgtggatttgactatttatatttttatttctgtccattttacctcatgaatttgactctttgttattagttgcatatatatttagaattgttatgccttattggtgaatggctgcttttatcattgtgtatacttaaagtctgcttcacctgatattaatatagctcctccaccttccttatgtttactctttgtatagtgtagctttcctacctgtttatttctaacctacctctgcctttattttaaaaatacaccttttacatggcacattagggttttgtttctttgattttaaattttttatttttgatttttgttggtacatagtaggtgtgtatatttatggggtacatgagatgttttgatacaggcatgcaatgtgaaataagtacatcgtggacaatgaggtatccatccacaaatcctcaagcatttatcctttgtgttacaaacaatccaattacactcttttagtcatttttaaatgtatgattaaattatcattgactatagtcaccctattctgccatcaaacagtatgtcttactcattctttctatttttttgtacccattaaccatccccgtctcaccttcattccccaccacccttctcagcctctggtaaccatccttctactctctatttccattagttcaattgttttgatttttagatcccacaaataagtgagaacatgtgatgtttatctttctgtacctggcttatttcacttaaccatctccagttccatccatgttgttgcaaatgacaggatttcattcttctttatggctgaatcagactccactgtgtatatgtaccacattttctttatccattcatctgttgatggacatttacgttgcttccatatcttagctattgtgaatagtgctacaatctacattttctttatccattatctgttgatggacccttagattacttccaaatcttagctattgtaaacagtgctgcaacaaacatgggagtgcagatatctcttcgatatactgatttccattcttttgggtatatatacccagcagtgggattgctggatcatatagtagctccatttttatctttttgaggaatctccaaactgttttccatagtggttgtactaatttacattcccatcaagagagtataaggtttcccttttctccacattctcaccagcatttgttattgcctgtattttgggtataagccattttaactgagatgagatgatgtttcattgtagtttttgatttgcatttctctgatgatcaatgatgttgagcacttttcatatgcctgtttgccacttgtatgtcttcttttgagaaatgtctactcaaatcttttgcccatttatggattcaattattagactttttcctatagagttgtttgagctccttatatatctggttattaattccttgtcagatggatagtttgcaaatattttctccaatcctctgggttgtctcttcactttgttggttatttcctttgctgttcagaagctttttaactccttgtgaaccaatttgtttatttgtgtttttgttgcctatggttgggagatactgctcaagaaatttttggccagaccaatgtcctggagatttcccccaatgttttcttgtagtagtttcatagtctgaggtcttagatttaagtccttaatctagtttgatttgattttttacatatggcaagagacaggagtctgctttctttcttctgcatgtgaatatctagttttcccagcatctattgaagagactttattttaccccagcatatatttttggcaccttttttttttggtccagtatgaaaatctctgtcagttgatgggtattagtttatttacttttaacataattgctgatatggctgaattcctatcttgctcctaacataccttcttttcggtttatcaacattttttaatactcagtttttacttgctctagtagtttcctaactatacctcttttattgtattttaattggtttctctatggctaactgtatgcatccttaacttaccagaattaatttagaattaatattgtaccttttaaaacttcaacatataacacaatacgtttgactttaacctttctactttccacttcccaatatatactttccacttcacaaatataatgaccttgcaacggtataaatccaatacttgtctcctaattctttgtgcaaatgctatcgtagcttttatttctatatacatataaatttctgcttctaatattatttttgctttaaacataaattacattttaagtactttttgaaaagaaaataaacctagtcttttgtatttactcatttatttactatttctggtgtatttcattccttcctgccgatccaaattttcttggggcataacttccctttggcctcatggttttccctttagaatttctggtcatggcaattgctggtggaaaatgtactcgggttttattctgaaaatgtctttattttacccttatttctgaagaaaattctcgctggatattgaattctctattgccagtattttctttcaagctttcatatcttacatcattgttttttggcctgcattttttaaaaatgtgtaataaatttatctttttttccctacaggtaatgtggggttttttttttcctctgtctgctttcaagattttttttttcatttttgttttttagaagtttgactattatgggcataactatagatctctttacatttattcttaagtaagttgtaatttcatcaaatttggaatattttcagccactatttcttcaaatatatatttttctgtctcattcacactctccttttctcagggactcaaataaatgtattttacaccattgatattgttcaacagacccctgaaatactgttcatttttctttaatctttttaacctcattacttacattgaataaattctattgattgattttcaatgttcctgactcttttttttttttttgctgccatcttcaatcttctggccccatctaataaaatttatttgtatttcaattactagattttttatttatagagtctccatatgatttttttatagtttccatttttctgtggaaactccctatgtgttcactcattaagatcagatttttctttaatttttgaccatatttataaaagcagcattaaagtctttttctattaagtccatttttttggccatcttgggtttgttatctatttttttcttttttttttttcttgactgtagagcactgcttctttgtatgactaaggagttatgtactgaacactgaatattggcaatcatatatcttaaagattctggattttgttagttttctccaaagaatgtggattcttattttaacaaggaattcatttgtttttaactcatgtagggtttggtataattgtaagcctcggatggtcctgcctggttgcaggtataagtccagcccttattcataaaccagcagaggacctccacatacaccttgaggaccactctctgcaatctccttatttttccgatgccatatttcacagactctagctatttcagcagccctaccctctgaattctgcctccttagttcagttagactgttaagctatgctgggacccctgttctctgtgcagcaattgggaaattgtttataacagagattcagggaagtgatggaactaatcttgtgagttgtctttctctaggggtcacagtcctctcttgcccgagttccattgcccaaaaacagttgactcacatatcttgtctaattttataggtgtttattgtggtagggctaatttggtgccagttttttcattcatgtctagaagtgaagttccactacttctgtctttttttccccctcatggcacttattaccctctcacatattagaaaatttacttatatgtcagacattaatagattattatctgcctcttctcaccaccttaccagaatataagcttcatatgaataaaggtatttgtctgttttgttcactaatgtatctcaggcacctagaacagtgcctggcacgtagttggtgcttaatcagtatattatctcagtcattttacaaataggagatggctcaaagggtgcatctatatgtattttttaactttcacattaataagtggtaaaacttgcttttgcatttgttctcaaacttctgactcaaaaacctatgttcttctcacagtagccttcttctttttctagtttctaaagtaagacagagaagaggaaatattaaggaataaaaaaactcggaggcaaaatgcacaactatgtctccatgaacttcctaagaagaggctaattataggtttatttactaactaaatacaatttattctacattctaggtggaaagctctgtacacaatgattaagacttattcctgggtaaggatattagtgaatctgattttggaattgtagttttataatcttatttatttgtgttttactttttaaaaactaaatatgatttttgaatgagaaattggagaaattgaagtctagtcatggcctagtctagtcatctatctattagctgtgaaactttgggtaaatagtaacctttatagacctgttattttcccccaaaattgttctagtaatacatgtttattccactacttctttttaatgtagatgaaacaagaaaaggaattccaaatgctttgaaaattataaactgcaatgtattaaatattatctgagctgtttaaaatttaaagttggtaagcctttataagtagtatgttaaagattacaagtaaaatgatatgtaaagagcagcagcagtattgaaggacatgtgtttattttgtgctaaattgaactttgcagcaggccttaataaacctaaaccagaaaagaaaaatttcttttacttatttgcttgaaaagaatgttataagacaaatttacttcagatttcttcaaaactttccattaaacttgttgtgggtataatgagggaaacttttactaatataaaaatataagacatagagtaaaaatgaaaagctatttcagggtacaatttcagaaaaggatttaagagtttggatcatgtttccacttcagagctccttcaagggattgaggggaaatggtgtagttttgttttcagttacaaatcggcatgatatacattatgtaaaaattatgcgagattaaacaccttttagttgcccaaggagaaatgcttctttctttcacatataaattcaaccttggccaggcgtggtggctcaagcctgtagtcccagcactttgggaagtcgaggcaggtggatcacttgaggtcaggagttcgagaccagcctggccaacatagcgaaaccccgtctctagtaaaaattcaaaaaattacccgggggtggtggcatgtgcctgtagttccagctacttgggaggctgaagcaggataatcacttgaaccaggaggcagaggttacagtgagccaagattgtaccactacactccagcccgggcaacagagcaaaacttcatctcaataaaaataaaaatgaaaataaaaataaattcatccttaataattttctttgttgatatgaatacttgttctgtttgatttagaaagtcttgcataattcagttgtatttctcttctcttcccttgggaatgcaatgaggaactggttatatatatactttgtaaagaaaatgtggtatcttagactaaaactactttagcaaatagtagttggtaagttaacaccaactactcccatccagaaagaaccaaccacataattctgggtttagtatagcatttatctcggcctctgagatcacattttaaagtgttaaaattgaatcttctctttgggatgttgcggtgagaattgttttttaagggaaaaaaatggagaaaaaatgggcaaaggaaattaacaagtaaaatctaaatagcttgaccaaaataaaattcgtttgaaaagaataaaaattaatgctttcaacctagtacaataactgagaactagataaatctatggactaagaggtccttgtagatactgcatgtgctaggatgaataaaagagattggaattagcaaatagattatgtgtcagtaaatatatgcttttaaattacttgaaggcacacaaaacagtttgtttaaaataacttgaagatcttagacattccctctcaaatgttatttacccactgcctcgctttgtttcagaaagctgtattccattcttttgctagaatgtaaaagtacacccatcatctttgtccctggtcctttaaggttaagtagaacactgacaaataatattcctctaatggagtctaaattaggagtaacaccttctcttataatgataaaatgagcactgagacctcaagattttaaaaagccatcataaggggtagtaaaaacggttacaatcactatactgcattgcaaattgtggtgactttggtttggaatatagtagtatgtcagcaacagatactgcttactctaaatcaacattcctttttctaacttactaaagaatctcaattttctacaggtatccacctatgcctcatgttacttggggagaggtgaccctatccttgcctcaggggcaaatattagttgggacaaaccagttatgataggtaatctcatcctcatctgccaaccctgccccactgacccagagttgggtcccatgcccagcatgggaatatgagagcaggttttttttgctttttggaaaggtttccttctttttaagacaaaggtgctagaagtaacggcatctttgtgcttccatgtggatgtaacgtgagctgcgatagctgtcttgcaaccctggggagagctatctgtatcagtttattagggctgccataacaacgtaccatggactgtgtggcttaaataacagaaatttatttgctcacagttctgaaggctggaagtctaagatcaaagtgttggcagggttgctttctcctgagggctcttgccttgactcttctcattgtgttctcacatggtcttttcctggtgcacgtgtgcacctgttgtctcttcttgggtgtccaaatttcctctttttataaggataccagtaagattgaagtaaaacccattctaatgacctcctttcaacttcatcatctctttaaaggctctatctctgaatagttatagtctgaggtactggaggatagggcttcaacatatgaattttggggagaggcaattcagcttataacaccacccatgggacaaatgagctcgctgacaatggtagaaaatatcaatggaaaaaatctgggtcctggatatgagataatatatatccttatgctgtgtaagcaagttgaatatgcattttctcttacttgaaattgaagacacataccttatatctaagaaccatggaacaaacaaaaaaccatcaatgtcactcctcttcctagactgcagagtttcaccagttagtctgtaatattgaaagagcatctggaagttcttccagttggagaaatagctgcatgtgttgaagaaccttctcaagtggcaagaaatcttcctcttgtagcactccccaggaaagatttggtattctttggacccagagaaaatgcttcaagtttttgaagctgcaaaaagactcaagatagttacatacagatttaaagtgtgccaatggaaagaatgttgtattcgggaaatacttagtttcttttatgtgcattttccccatgacaatgcatgaaatgtgaatattaatatttagacagccccttaatggttagatagctagcaaccaggctctgaatactacaagtaaaaaaagttctacagaaagctatttcttataaatattttattaaatggctaatgaaaaataaatagtctgcatttatctagttattgcacaaaacattttcatgcgcattattttagtgaatcagtacaccagggtgggatttttgtggacttattttgcataccaagaacttacattaaattgtccattcaaatgaataataagagtaggagccaggaaccacaggcagattttctgtctctaataggtagaaatcccaatttgcaaaacaaatacataaacaacaaaacaaaatataaagcaaccataagcatatttttaaagattcttttatcaaatgacaggcatttttgccaactgggaaaaaataatatggaaaaatgttatttggctttaaaagaaatgaaaggtataaaagtagaatcatgaaatttctaaagtaaaaaatgtctggattcgggcaagatggcccactagatgcagccaggtagaactgctgccactgagggactgggatgactggcacactcctaaaagatcttcagagggaaggcactgacagtgaatgcagaaaaaaacacagaaactgggctgaaggggaagaagctgggaaccatgtgtggggcttctgcacaccaggactcattcttggcccccaattactccaggggaatgggcgagttgaactggcagcaaacaactcgctctagccatgagcctctggaatcccagcaagaggaaacccctcaaccactagggacacttgagttggcagggagagctgcttagagaagtggtaggggcagcaggccagctgatgcagagcctacagggcttgctgtaggagcatttgtagtagagtagggccaggggtgcccatccctccaggatcaacttgctcccataggagactttagccctaggggaactgttggaacaaaattctgcagtgttgtcttgcccttcagatggggtggtgtgacctgagcaccccttgttccactggtttcttctgggttcccagcctggctgcacctgtttgcattgcagcctctggtgccctgggggcctgcatcatagcttctgcactggtagatcattcctgaacagtggacagcttcagtagggcagtcctcactgccatacaccagtctgcccactcccccttcccactgcagcttccccagggtccatggccacccccatattgctttgtcaccatgtgtggtggggggacactttgccttccctgccctaccagggcacatggatgtgtggaccctgccagcaggagtgcactctgccttccctcacccaccatactgccattgaagttggagccttggcaagcacagagcccactagccccacccctgcaccaacactgggagtgaaactaggcacacagaacaatagaccctcccctgccctgagcggccacagagggtacacaaagacctgtgcccgccagtgcccctcctctgtgctaacaccaccaacaatgcaaccatgcatacagtcaccaacaggatgccccctgcccacaccaatcataccacctttgccactgctgtgaacacctgcatgaaggcaggcaccccaacatccactagcatcctgcgacagccgacgggtgtgcaccccaccacactgccactgctgctggcacatatgaatgagaatggatcgcactgccatcaccctatgaaatgctttgtctggcagcatgtatcagaatgcaatcaacagtggccaacaagcacttaggcacccctgccccatgcagtggattcctaacctcaaggaaccagagaacaaagttagggcctgttataaatcctccagaggtagagcacacagtctaggagttgggagatgactgttggtcccctaaaatcttccaaaaatgaatccagtagactggacccaccttataccacaagcaaaccctcaatgccatcaaataggataaaagaaaaaaatctaaaggacagcaacttcaaagattgaaggaacaccagtccagaaacatgagaaagaacccgcacaagaagcctaataacaaagagccagagtgccttctttcctccaaacaaccacactacctctccagcaagggttctgaactgtgctgagatggccaagatgacagaaatagaattaagaatatggataggaacaaagatcattaagatgcaggagtacattgaaaccaaatccaaggaagctaaaatcacaatgaaacaatacagaagctgacaaacaaaatagccaatattaaaaagaacttaaacaacctgatagagtggaaaaatgcactgcaagaatttcataatgcaatcacaagtattaatagcagaatagaccaagctgacgaagaatctcagagcttgaagactggctttctaaaaataagacaatcaggcaagaatacagaaaaaagaataaagacacataaacaaaacctccaagaaatatggcattatgtagaggccaaatctatgactcactggtgtccctgaaagagatggggagaagagaatcaaattggaaaacacatttcaagatttcagtcatgagaacttccccaatctagctaaagaggccaacattcaaattcaggaaatgcggagaaccccagtaagttacttcacaagaaaatcttcataattatcagattctccaaggtcaaaatgaaagaaaaaatgttaaaggcagggtgagagaaaggtcaggtcaggtcacctacaaagggaagtccatcagaccaatagtggattttttagcagagacccaacaagacagaagagattggaggccaatattcaacattaaaaaaaaaaaagaaattccaaccaagaatttcctatccagccaaactaagcttcataagcaaaggagaaataagatcccttttcagacaagcaaatactgagggaattcgttaataccagacttgccttacaagagcttccaaaggaagcattaaatttgaaagactaatcagccactacaaaaacacacttaagtacacagaccaatgacactgtaaagcaaccatacaaacaagtctgcataataaccagcaaatatcacgatgacaggatcaaatccacacatatccataccaactgtgaatgtaaataggctaaatgccccaattaaaaggcacagagtggcaagctggataaaaacgcaagactcaatggtatgctgtctttaagagacccatctcacatgcagtgacacccatagactcaaaataaagggatggaaaaagtctaccaagtaaatgataaacagtaaaaagcagaggttggaattctaatttcggacaaaacagactttaaacaaagattaaaaaaaagacaaagacattacataatggtaaagggttcaattaaacaagaagacctaactatcctaaatatatattcccctaaccgaggagcacccagattcataaagcaagttcttagatacctacaaagagacttagataaccacacaatattagtggaaggcatcaacaccacattgacagtattcaacagatacatcgagacagaaaattaacaactcagcactggatcaaatgggcctgagagacatccacaaaactctccactcaaaaacaaaagaatatgcattcttcttatcaccacatggcacatactccaaaattaaccacataatgagacataaatcactcctcagcaaatgcaaaagaactgaaatcataacaactactctcttggaccacagtgcaatcaaattagaaatcatgactaagaaatttactcaaaagcatataattacattgaaattgaataacctgctcctgaatgacttctgggtaaataattcaattaaggcagaaatcaaaaagttccttggaactaatgagaacaaatatacaacacatcaaaatctctggacacagttaaggaagtgttaagagggaaatttatagcactaaaagcttacatcaaaaagttagaaagatctcaacttaacaacctaatatcacaatgaaaaaaactagaaaaccaagagcaagccaatcccaaatatagcagaagacaagaaataaccaaaatcagagatggagacatgaaaaaccattcaaaagatcaacaaatccagtaggtggtttttaaaaaatattaataaaatagatcactagctagactaataaaaaagaaacaagagaagatccaaacaaatacaatcagaaacaacaaagggaatattaccactgacccgacagaaatacaaataaccatcagagaatattatgaacacctctatgcacacaaactagaaaatccagaagaaattaataaattcctggatatatatacccttccaagtgtgaaccaagaagaaactgaatccctgaacagacaaataatgagctttgaaatttaatcagtagtaagtagcatatcaatccaaaaatctcaggaccagacagattcacagctgaattctagcagatgtacaaagaaaagctggcaccattcctgctgaaactattccaaaaattgaggaggggggactcctccgtaactcattctatgaggctacgatcatcctgataccaaaaccttgcagagacacaacaaaaagagaaaacttcaggccaatatccctgatgaatattaatgcaaaaatcttcaagaaaatacttacaaactaaatctggctgcgcatcaaaaacaatatcaactaaaatcaagtaggctttatctctgggataaggtttagtcaacttatgtgaatcaataagtgtgattcatcacataaacagaactaaagacaaaaaccatgtgatcatctcaatagatgcagaaaaggcttttgataaaattcaacactccttcatgtttaaagctcttaataataagagccatctatgacaaacccacagccaacatcatactgaatggccaatagctgggagcattccccttgaaaaccagcactagagaaggatgctttctgtcactattcctattcaacatagtattggaagtcctggccagagcaatcaggcaagagaaagaaacaaagggcatccaaataggaagacaagaagtcaaaatattcctgttcacagatgacataattctatatctagaaaaccccatagccttggcccaaaagctccttaagatcataaacaatttcagcgaagtctcacgatacaaaattaacatgtaaaaatcactagtatgcctatacaccaaccaccattatgcagagggccaaatctggaatgcaatcccattcacagttgccatgaaaataaaaaaatacctatgactacagctaaccagggaggtgaaagagctctacaatgagaactagaaaacactgctcaaagaaatcagagatgacacaaacaaatggaaaaacattccatgcttatgtatagaaagaatcaatatcattaaaatggtcatgctacccaaagcaatttatagattcaatgctattcccatcaaactaccaaggacattcttcacagaactaatgaaaactattttaaaagtcatatggaactgaaaaaaagcccaaatagctaaggcaataaaaaaaaaaaaaagctgggggcttcacgttaccagacttcaaactatgctacagggctacagtaaccaaaacagcatagtactggtacaaaaacaggtaaagcaatggaactgaatagagggcccagaaataatgccatatgcctaaaaccatctgacctttgacaaagctgacaaaaacaaacaatggggaaaggactctctattacaatagcaaatcctgtttaaatgcccattaatggtagattggatagagaaaatatggtacatatataccatagaatactatgtggccataaaaaagaatgagatcatgtcctttgcagaaacatggagaaagctggaggccactatccatagcaagctaactcaggagtagaaaaccaacaatgcatattctcacttacaagtaggagctgaataatgaaaacagatggacacatagtggggaacaacaaacacggggcctacaggagggtagagggtagaaggaaggagacgataaggaaaaataactaataagtactaggcttaatacctggattactaaataatctgtatgacaaacccccatgacacaagtttacctttataacaaatctacacatgtactcctgaacttaaaataatttaagtaaaaaaaaataaaaaatttgaactgaaaaattctctggatgtaatacatcagggaatattttaatattttttttgaaaactaataatataagatatcttaataacataaagagaaaaaagacattatagacaggggagctaaaataagaatgattactgaactgaatacaagctagaaggctataaaacgacttatttcatgtaacagaagaaaaatgggccaggtgcagtggctcatgcctgtaatctcagcactttggaagggaggctgaggtgggtggatcacttgaggtcaggatttcaagaccagcctggccaatatggtgaaaccctgtctctactaaaaatacaaaaattagccaggcttgatggtgcatgcctgtagtcctagttacttgagagactgaggcacaagaatcacctgaacttgggaggtggaagttgcaacgagccaagattaagccactgcactccagcctgggagacaaagtgagactccgtcttaaaaaaaaaagaaaagaaaaaaaattggaaaactcacaactgtcaaacaataatcaataagaagcgattagatctgggaccgaagatcttattagaattgtgatcaaagagtaaaactcaatcattagaattttatttggttccccttcacaggtaccatgtaggaggtaccaaagaaccagacatctgtaaactaaaattttatttttctgttctcaactaattgtgcaactgtcttactgtcaaatctctaaaataggtggtcaaactaaatcttagactcttctaagattctttgaaattgtgatgtggagtagaagcaaaaaatatcaaaattaatgcctccttatagagcatccaaaaatgttttctaactgcatatttgatgcaaatgtacccaaagaatttatcgtattatccagacaaattatattcaggcatatatatgtatgtgtgtatatatgtgtgtgtatatatacatatagatatatatgttttaacatttgaaatgtaattcatgacattggaaccatttttgtattgaattagatgtaaaataaattgatactgattccattttacaaaaaagttaccatatagttaaactataataatttccattgatggaaattaatgccactgaattatgtaaaactgtaaaaaatataggcatgttccttttgttttatttcagaacatatttctataccaatgagtaaataataattttatgtttctttgtggtaatcagaaaaaaatacacactactcttttatttatgcggatttaattaccatatttacatattttctgccttttgattggttcatacatctgttcttaatggttctatgaaaattatattaaaaccacaacgtcaaggttttgatgagtagctcagaagcaacccaagtacaagacaaacattagaatataatgcttttcatggctagtgatggagtggggccatttatcatagagccaaaaaagcaaaaaattagagatacatcagcttccatgtttgagatttttaaaaatagctaaatgcttccaaatgtgcaagtttacccaaagctactttaattttactctgtttctatactaggaataaaagtttccaaggatagagtaatactttcttatgaaaattccaactgatcatactaaatatcaggtcaaaaatcctgtttaaaagatatgagatggtagtgattttcttgcatgtgagcaacatgaaaatataaagacagatcttaagaactattcaatcaacacgtcataaacagtgtgttcaaaatttagaaaatatatttgactatcttttgaatttaggctggttcagatagtaacctatcaagaaagaatgaaccagtttaaggaccatggaataagggaattaggtaagatgtaaattggaaattatagatagcactgattgcttaatgctgaaataatcaggaatacaaatttatcctgtgtcttcttgagtggttcaagtgcttctcccagatggaacactgaagtgccatccttcagcttcacatcgctaatatgtggagattcaagtagccaggtacaatagactcaaataccattattctgttattctaagatacataatctaaatacagaataataaagcaaatgaaatctcattataactttcaattataagattcttggtcattgtttgattttgttttgttttattttgatactgagacaaaattataactaatataagcaccaagtcaacaggaaactgagtattcactaagaatggctaccattccctagtcacctttctaccatcaccattccaaaattagttaaatcaagaaagaaaagataaaagggaaaaaggatttattgtttatcagttcttattccctatcctttcctgtttaatacaaatggtattagacacatggaaatttttttaaaaaatacgtaaagaaggatatgattgtatgaattggttctaccactttggagagcaatttggctcaatgacaaatatctccaaaacattatattgagagaaaaaaattgacagcatattaaatcttattattgggtacataccaatataagaataaaacatgcatgtaaacaataaacatgaaatcagaatggtgtttatgttggggaggaaaagaggagtagaatatccagagagagaaaaacacagaaatattttattatgtttataatgattaatatttttataccaagtgttaggggtgtttattacagtactattttacattttggcatttctaaaatattccataataaagtttgaagaaagcaagactatttagctagaagctagaagagtgatttagtttttatgtgaagcatgagaactagctgttttctgcctccataaatagaattggaaatttaggctaactacaaagtttactttcccactttagtgagttcttataggttgcaaagaaaatttatgtggctttctgtgaacatcgtgatgatgaggctggattcttatctttcttaaggagcttgggtggtcctggtttaaagtgggcgacatcgcccctctgctcctctctgactttttagttcttattgagagattacaatcgtttaagatgagtaagcagaaaagggaggaaagaagatgtatgagtataaatatcagagattaaagcccccaaatgaggccagataataaacatcagagaaatggtctctttcatttttgtcctttattgtagcacatttctaagccgactagatttatcttcaattttcatttcattcaatgttttgaatctttttttttattgtagaggcagtctcctggaaaaagaccttaaaaatatccccaaatattcagccaaatgacagagtcagttggaaagagtgcagtcattcacttttccatttctgtgtccagttgagattgttgcaggcaatgcccgtgttcattatctcttttactgagacaagatttaacctcacacaacatctggaaatatcagaccttttactttctggtatttctggatgagggaccacatgcacagactctattttgtaagtactgtataggaagagcaagcattttttcaataccatttatcaattgttaatgcttaaatttctgttttggtgtgacatttctgaaattcagcctcttctgttacatgtttagaaatcaatgtgcatgtttatatggacaggatggagtttgttttatttcttaccccctgaatatttgctcactaggtctgctaggggacctgccagttagagaaaatgaccattatgaaactaaggttttttgcattaattcgttatgcagtatagacatatttcccagaaaatcaattttgccaacccggaaataatgcaagcaccatgactgccaggatttttgtctgttgtgtgtgtggcttttttattcccactagaaataaacaaaaatcgttttgacttctcagtaatgaatgtttaacctaaatggtaagggatgaagtcatttttttaatgttagtggaagttggaaaatccagaagtgcctatcatataatctcagttatttctacaatagtacgaagtttgccgttttcttgcatcttgtacacacacacacccccacacacatatctgctaaggaggaaaataacatatagcatgaaccaggttattcaataacaatctggaaaatttctaacttctttatgctaggtcttccaaaatattagctatgtatttattcctgatactattctgtttcaatatgcttctccatgggtttggcttaatccacgtgtatatgcagtgcagttaaatggtagagatattttaaggctttttctaaatttctttcccaaacaataagacttcgggttcataagtgagcttcattcctctctgtctccagcatgataacagtaggatgatactcaagaccacacaaagaagaatccaagagaagaactagagagaaacaacacaagcatgagatcccagttgactggggaggtgacagtaatgtggattggactctggaaggtctgagtcttaattctgcatttgtcagaagtcagttgatgaactgggaagttacttagctcaaggagtttactcttcatctgtataaagtttgggaataaatagtctgaggttcttataagttctcaaattctgtgagcctatttctactccacttttataaaaaaaatagaaattatccaaagcaaaatgttgcccttttttaagacactttttcttacttttttttttaaatcagctgtccttcaggtttttaaaaaatctgtcaaaattatttttagttttagtaaaaaataaaactttaacttctaaattttaagaaattcttatttgtagaatcacaaatcaaaatttcctgagattctttagtttatttcttttcttatttattattaaatcattttttacaagatgcaaatattctacagcctgttcttttaaattggtatgtgtaattgttcagcatgttcagcttattaactgctaggaataaggctgtcattcattttgatcaataaaacaagtatctttactttggaggaataatgtatccaaaacaatcaacaaaggggcacttgtcaaccttttagctttggttaaaagaaaaaaagtagactcataacacaccactctcgaccacagtgatctttcccctgagctgcaacgattgtgaggcatattttgtgaaagcaactcgtatgctctcctccagtggttgccatctacacttcaatgtcctagtcctccagcacactgagatgcacccctactctcgtgttcctctagaaaaattattattataaaaacaaaatggactatgaaaaatagcctctttgaacacaaattaatttggagtagactttatatagttatgagtcaatttttcttccacagcaaaacacaattccctttaaaatataaacaattggtggattttataataattttaaatccaaaaccaagtaatacctttgtacatgtatatgtgttatttacacatgtatatagtatgtatatgttatttacatgctatttacacagaaacagagagagagattttaagaaatgaaggaatggttcataaaattgccggggctggcgagaccaaaatctgcaggacaggctgcaggctggcaagacctagggaagtgttaatgctgcagctccattctgaatgcagtctgaaggcagaatccccatttcattaggggactccagtatttttctttttcttttttttctttatacgttaagttttagggtacatgtgcacaatgtgcaggtttgttacgtatgtatacatgtgccatgttggtgtgctgcacccattaactcgtcgtttacattaggtatatctcctaatgctatccctccccgctccccctaccccacaacagaccccagtgtgtgatgttccccttcctgtatccatgtgttctcattgttcaattcccacctatgagtgagaacatgcggtgtttggttttttgtccttgcaatagtttgctgagaatgatggtagccataaaaaatgatgagttcatgtcctttgtagggacatggatgaagctggaaaccatcattctcagcaaaccatcattctcagtatttttcttttaaggccttcaagtgattagatgaggcccacgtacattagggggggtaatctgctttactgtgctctattgatgtaaatggtaacttgagctaagaaataccttcacagaaacatttaaactctgtttgaccaaatatctgaggactgtgagttgacacataaaattaaccatcacagtgctcaagctaaataacattattctttgctaatttaagaaataaactggccagtcacagtggctcatgcctgtaatcccagcactttgggaggctgaggtgggtggatcacaaggtcaggagttcaagaccagcctggccaacgtggtgaaacttcatctctactaaaaatacaaaaattagccgggcatggtggtgcctgtaatcccaggtacttgggaggctgaggcaggactccagcctagtcaacagattgagactctgtctcaaattaaaaaaaaaaaaaagaaagaaaagaaagaaactaacacatccagcaaatgtcagtgtggtacagaatctatgggtggtttaggaaatagttaccagaatgaaacttttctcctccacacattaagctttttgctctagcacactctataaatatttgtaattctgaaatgtttttcatgaattctgaaacaagaattttgaaggagcatatgtcttctggaataatttttcaacactggaaatactgatttacttatgctgtacatgaggaagttcctagaaatgcacttttaactgaaagtgttcaagggctgagggagagatgggctttttacattgtatattccttgattctaactcaattaatttaaaatgcagggagtttagtgtgttaataaaagggatttcaggtgttatgggaatagagtaaaatgatagccagcctgtgagggagggaacaggggaaggaggctgtccagggacctgcacatctgagctgagaaactgtaaataacatggtggttattaaagtggctcacgagttaggtcagctaggctcagatccatgctctggtactaaataattgtgtcttcagaaatttatttaatttttctagtactctgtcttctcacctataaacatacagtttccaaagtgtagaaggattaaatatgaaaagtacacctaacgtacctcacgccttgtagtcagtggcacatagtgattaatattattaattattattattattgtcactaggtagaagatgagggactaaaatgagcatgtgctagttacattgatttgttttcagtgtctacatgggattggatataggtgtcagaagacacaatcgaatcgtaaaagaagaagaaaaaaaggaaatgattttctgaaatcattgtacattttaatgtgtttaaaatgttaagtaggaaggatgtttttgtaagagactattctgtaagatgtaactttaggcaaagtacaattgcttttaataatttatgataggagatttaaatgttccagttaatatatctcttttagatagtcacctggaaagtagcatttttattctagagatgcctccattgaccacaatgtttttatgtcatcaatttttctgtttgtattgtttcgttagattatgtcttttatgtttcttcggtgtcaggaaattgtttacttttaaatgcaattctgaattttgcgagctaaaaaaccagctggaaacaaatagagtgaacaatatggattatgtatttttttagtttttagtttttggtcatgtggcttggttctgatttcaaggagtggctgaaaaattaagcaggaaagcaattttcaaggaagtttaaaaaaacattttgtggtagaatagttggaatatgtctttaatatcaaaatgtaacaaactggaagatacataataaataccccttgttttgtttttaaaataataatttcattaatttatatagaaacaaacatccttttattcctttttattgaatatatacaatttaagtaacattactcatggcaaaacgctaatggccaaaccagaaccctaaatccagcagcaaaaaaaattccacctatgcacgtgctttttcctttctcacacaaacttatactttattgacatcgaaaagatataatcttaaattaggatggacttattatttttatatgcacaaagtgtggcagcctttgcctatgtctaacatattggaaacatagttaataggagaatgagccctggaccagaagccagaacacccaattccggcccttgctctacacgtctcagagttatcaggagcaagatgcttaacctcttgatgcctcagtttactcatctataaaacctggctaacaatatatatcatcattccctccaaaagttgtcataaaaattaaatgtagttgtacattttgaaagtctgaaaaatgtaaaataccaaccaaatgctaggtactgcaatatatgttcttcatacctgggaaaaaagagtcccaactaacaaatgcattttataagcccctttatttctaaaattaagtagatgaattatatcccagttattttagtttgttttctctttgtcatcacatgtgtaaaaagttgacctgttttaactgtagttaaagatacaaaaagctcaggttttttgacacagcctttttgaatgtagtaaaatgcagaggccactcacactatcaaaccaattctgtaggttgaaatagtggtctacactaattaggtgtgtcaatgtagagagaaagtctgtatgctctgaagcctatctattcatggagtattatctattttacccacaaacaggaatttccccacaatgtactgtcatcacagagcaattaaatatatggtttgcatacttctcaatggtaaatattttgcctggttcataaggtcgtatatcatgcatttgtttctatttctggctagaagagatggatataataattatattcaataaaactggaatgtaatcccacctatggtaattttttttcaaaacacatacatatatatatattttcaggagagttattttattaaaataacaaaatttagaaatcagtaatttttttttttttttttttgagacagagtctcgctctgtcgcccaggctggagtgcagtggcgtaatctcagctcactgcaaccttcacctcccggttcaagcaattctcctgcctcagcctcctgagtagctgggattacaggtgcacaccaccaagcccagctaatttttttgtatttttggtagagatggggtttcaccatgctggtcaggctggtctcgaattcctgacctcgtgatccgcccaccttgacttcccaaagtgctgggattacaagcatgagccagataatttatttttaaatatcaaatttatagccagaaatttgggttttggtttgctgtgcttacctgtcctgaattatagtagaagcaaaataaaatattagcatgttttaacctatttatttgttctctcaaaataacatattttgaagaacatctatcaccctgctaactaatgcttaattattcattaataaaaattctttataacttgaactttgttgactaattattcggactacgaaactccaccaaatattctcattaatgtaactcatgttttggatgtaataaaaatagtgaattctgtaattatcccaggtgctattaacatttgttgaacatgcagagcaaggggactacagacttctgccaacacaaagacaagagaaatttgctttagcaaatttgccttctatttctttattcaatctgattgagtatggtagcaagacaaagactttttttctgtttctggtgaattaattgcattgttagtgtttcagaaccatatgaaacaatttccctttaaattaatataaacgagaaaatgtaccacagtctctttgtatcttttgttgtttctcctttagagcccaatgtttcatggcagtcgagtttctggaattataaaaagtataaaattattttaaaaacagtaaaaaagattgtgtatacaaaaataattcttctaaacccattaaaaatagaattacctttctctcagaactaataagcaaataaaactagctgagattacaatcactcgatgtaaaaattctaatcttacatgattcgaagacaaatatttttcccaaaggcataacaataagcatatccaaatgttctttccagcagagaagaatgaaataaagctacactctataaacttcagtgcacgatgtgtcaactcaaggattagtgtgtatttcagaaaataatattgaaattcgtgtttttattacttagaaaaattcacttctgtaagtcaaatttattcatatctttttatttgtttactaaacgctaaaagacttcacattaacatcatcacaaatatttagccaagaatgccagctgttgattatgggcctatgacagaggacttggcatatttccaatcagatgcttctactgtatcccaaacagagcattttaaaatacagtgcttctctgctaacggatgttaaattttcaaatgagcatatttgggagaatgcatctacgtattgacacaaaaccaccagacatgggcattgacatacagctgagaggcaaggacatctcctaatgatatggcactgccaaaagccagagaagatgggagtctcacacatacaaactctcatatattcatgtccagaacagtgatagctcgtatttctcagtatttgccctgtctagctaagtgatttatattgactagctcatttaatcctttgaggcaggaactattcttctcaccattttagagatgaaaaaactgatggcacagagatgtcacattatttgtccaagttcccaaagccattttaacttctaagcccacactttaaatcactatgctatgaagtgctatctcacacacactggaattcagacacagggaaaaaagatcccagtgagacaattgcagcatcagattaggcatatggtacttcgagagtgccttgtctagcatgaagtcagaaaacaagttgagtggcctttatcgctctgagtcttccgtcttttgtttaagcatcactgtgcccagagttggcatttatcatatggctacatttaactaaataaaaatatcatcctttttcaacatatgaaaatccccaaacttcaaagttgactccaaaatgtgcttgtttttaaaaattggcactcaagtatttagggataaaggctctttatgtcggcaacttattctcaaacaagtcagaaaaatcactcatacacacacacacacacacacacacacacacacacacacaaagaaaatctgataaaatattaatttgggaatctaaatgaaagtataggataattctttgtgctgtatttgtactttttctgtaaagtctaaaattaaaaagctgcctggagattcgaatagtcaaaaaaaatttattgagaaacagcaataggaaaattaaggatacaaatatatccagattggcatgtccaaaataaaacattactcatttttttccggcacatgtagaagactgcttaacaccccctatcttttttgcaatatagactagaagagaaattaagacctagattatgttttcctttctacctaaggcctctatttcggttctagctttctatttgtggggttttttccccttctaggtcacacaatctcctttctacaagactgagttgcatttgaaagttttaacagataaacaaattagaatgcaataaaatagccctaatatccacaaaagaaatataatagattcacctttctacattgaggctaaaattgaatttcaaggcattaggtgaattagtgtatagccaaaactatcctagaataacctttacatagcccatcaagtaggggatcattgttttgtatagtaatgattatgcacagtaaattttgacaaccgctaacctgaacaaaaggaacaaaataaaaacttacatgcaaatgtctaagcattcaaatgattttgcttttaagataattatcaaatcctcagcagtataaggtgaggaataggggggcagtgagaagaaaattttaagtgattttgcttgatgtaaactttattccatttggtttcatgttaacataatatatgtaagtagatttgtttgtcagggttaaataagagtacagagataaattttgcttccagccatgaggaaggaactcacatcatggtaggccttctgtcacaagccattgtaaaagaggacaaaatgtgtgaaatcactgcttttagacattcagcaaaagacaccacgtgactatgatccctgaaagaagggcaaaaacatgagatgagtcctgtaattgtaccagctttctgcctggtgtcacttcctaggctgtggttcagagatggtgcccaaaccaacacagcggtgccacatagcagaggagacagagattagaattcagggccagtgaggtgactggaatttgtattgcaggatcaagagagaagcgagctgagcagaggaggagttccaaaaatctgcatagaggtccctttgagtctttgaatagcaagctgtttatattcagattgaaactctctgaggcaggacaaagtataactattaggaagagaacaaacacaggagaactgtgagttgagctctcagagctagacagagtgtggagatatttgcattctgacttgccaaagtgaaagcaccttactaaacactgtaggtacaatattgctatagtttggagctttgtcccctccaaacctcatgttaaaatttgatcctcaatgttggaggtggggcctaatgggaagtgtttggatcgtgggggctgatctccactaaatagattaatgccttccctgggggcaaggtgagtgagttctaattctattagttccctgtgagagctgcttattaaaaagagcctggcacctccctcctctctctctctctcttgcttcctctctcaccgtgtgatatctgcacatgccagctccccttcaccttctgccattaatggaagcagcctgagactttcatcagatactaaatcttccagccagcagaattatgatccaaataaaccttttttctttacaaatacctagttcctagtattcatttataacaacacaaatgaactaagacaagcgacacaaatggactaagacaagtagaaactccacacaggccataccttagaagtagggctaatctagtcctacaagaaaggttattcttgacctaccttaacaacaagacttgaaagtatcaagctcatctacaggtaagttaactgcctatgggaaaaaaacttaacactcttattaaggaagatgatagaaatccagtcaacaatgaagtatccataatgtttaatgtataattttaaaatgaccagtcatgcaaagaagcaggaaaacatgatccattgccagaataatagtcagtcactcaacaagaacagacccagaaatgacacagataatgaaattaatagacttgtctttaaaataactactataaaaatattcaggaatttaaagagagaagacaacgaaaaatagaaaatctcaactgggaaacaaactataataagaaatactagagataaccagaaatttaaaattcaccaaataagcttatcagcagattaaatactgcagaaaaaactatcagtaaacttgaaaatagagcaatttggaaattacccaaactgaagcacagaaagaaaaaacagctgaaaaatagtaatggattatcagtaacttatggtagaattgcaagcagatttaagaagttaaacaatgcctaagcaggaataacacaaagaagaccataccagggcctattaattagggttccatcaggtaagtggaacgactataagtgatgtacagtcagggatttattttgaggattagaccttaggcaattgtagaagcttcttaagtggtctatataaggctatcaactctgtgctaacattaggcctgaagtcagcaaggaaatatagacattaattaagggggatccaagagtgaaccctgagggaacttgtgggggaaaagtgaaatctataaggcaaaactagaacccacgagaacaaataggaacatgtatttgtcccactccctccaatcttgataatgtaagtgaactgaaaacaaagctggcactcttccctgtgaaactatacatgacttggcctgggattcaaagatctaacaaagtatttctggttagaaaaactaagcccaggttttgctccccattaccagtgaggtaaaccagtagatcagtaacagtatgcatgagctacaatagtacctcaccccgtgccaaccttcacagtgttaaagaccagctgttacttcacttctaccttcccaatctcacacaagtttctgttgtgacccatcataaactggaatgatacagtgaaaggattcctgagaaacattccagtttagctatactgaactgttgccacagtccacccccttacaacttggcactcccatatacacctttcaacaatacttaacttctaaatgaagacaatagtaaaattatctttttacatagcacaatactgatatatactaaaatactgatatataactaaaaacatgctaaaactctctgaaaagatgatacaaaatccctttattcaattttggttaatgtttatttttcttctaatcgaatcacactccccctaagatatattataacttaaatactgaaatataagctcagttactattaatacttcctatgttatatgttagggagatggagggagggaaaagatagttggatggagaaaaaaatgtataaatatcttcatataaaaataagaaagaaattctcaaatattatggtgttcatttctgcagctggtgacatgatttcagttaatatttgttacttcagtcttctactacccactcctattccctttgtcttcagtaagcactttgcctggtcataattctttgcctaatggggtaaaacaagccttcatccctgaagtgagataaactgctaatggcccagccatttgcagttttgctgtagtttttctttgactcttatcacagagcatggaagtattaagatgtgtcccaagatattttgtgaattacaaacacattcctccttaccaccatagtgcagtcaaaacttaatttcctcttgatggtcaaaatcagtcattgcagtcagtataacctccccttctctgcccattgatttaccaccatgagaatccctaagtggtcatatgacagcgtcaaattttcatgtaatagaaccattgctatgtcccctggtggaagcattcctctcttgagaactaagacctctagacaagatgagccaaggttgcatagataagaagcaataattttgttagtaatggattaggggtaagcaaggagataagccattcactttcatttccacttcttgattcccagatctgtgtaatgagagaaaaacactacaaattggacacagattcagagcatatgctctattttggatgacattactcaagccctacaaagtgttgccatgcatctggcaccataatttagtcttcaaaaggccattctatcaggccagctgcttcagagtgatggagaacataataatacaagtgacgtccatgttcacaaggccattgctgcattttgttagctgtagaatgagtttcctggttagaagcaatgctgtgtggaatatcatgttggtgaatagggcattttataaatccacagagggtgattttggcagaagcattgtaggcagaaaaggcaaatgtatatctagaatgagtttccattgcaatgagaacaaagcattcccccttttatgttagaaataattaacctacttgctaccaagtcacaagctggtcctcctgggggctcagtatccatctcaggtagcaggttgggcactcagcagtggcagttgtcagatcagctttgatgagtggaagtgaacattgcttagcccatgcatagcttccttcgctgctgcccatgaccactttgtttatgagccaatcggacaaagatagatgtagctgcagaaacaagttcatttatatccatagaatggaccactatgcccacttattcatctgaagtggctctttggtgagccttgatatcggacacaaatatcttcatgatctatgcctgatgtgatctatgccaagattcacatacatctttccagacctcattatcaccaagtcaccagtcatgttccttttaattgagaatcattcagccaaactcttagccacaccgtttaaactagtggatatctgaccatatctcttcctccagataaaactttacccaaggattacaacaggcaaaaatatatttttttgtgttttaatcagtgctataaaaccaggaaataaaataaattaaaaacataaatgttggaaagaaaaaaagtatactgtctttattcaaacataacatggttgtgtatggtaaaaactataattatctaaaaaatatactactagagctcatacatgattttaacaatgccacagacataggttaacattaaaataaccattgaatttctatacactagcaaagaatgggaaaactaaataaaaaatccaatacaatttaaaatagtatcaatggacacaaaatacttggaaaacttaaataaaatatgtctaagatctgtatgctgagaataaaaaacattgctggaagaaattaaagaatatttaaataaatagaaatatataccattttcatggatttgaagactcaatatttttaagatgcattttttttttctaaattgatctgtagagtcaaagtattcccaaacaaaatcttaggtgtatttttattttggtagaaattgacaagatgtttttaacatgtatatgaaaagaccaaggctgggcacagtggctcatgccagtattcccagcactttgggaggctgaggcaggtggatcacctgaggtcaggagttcaagacaagcctggccaacatggcaaaaccccaactctactaaaagtacaaaaaaatattagccgggcatggtagcccgtgcctgtaatcccagctacttgggaggctgaggcaagagaatcgcttgaacctgggaggtggagattgcagtgagccaagatcatgccactgcgctccagcctgggtaacagagtgagactctatctcaaaaaaagaaagaaaagaaaagaccgactactcagaatagccaaaattatcttgaaatagaaaaatactttgtagtacttatatcacttgatttcaaaacttattaaaatcaagatggcatgatatgatgtaaagatagattaatagtttaacaaaaacgttagtgagtccagaaactgaaccacatttacccagtcacttgatcattttttaaatgagtcatcaacataagttaatagggggaagaaaagtctttttgacaaaaggttctgtaaaaaatgactacttataagaaaaaagttgcgcctcaaactctgcaccattcataaaaattaattcaagaaagatcatagtcctgaatgtaaaagataaaattctaaaacctcttgaagaaaacatagcagattatttttgcaaccctgtgagagacaatccgaggccctgaactgtgggtttccatgtctgtttttgcattgcccaattttagcaaaaattctgtcaaatttgtttaaccagaatctctcacccttcatatctgatcattgtcaatatttgaccaaattccttatctcccaccacctcccagatgatatctgattactctgccctgacttcagcaagaatcctgttaagctgatttaaccagaatcccttcttactcctcatgtttcctcttagtaattttccatccactgccccaacttgcttcttgtctataaatgctcacttgtctttgctggactttcagagtctggaagtccaagatcaagttgtgagcaggattggtttaggggctggacatggagaatgtgccagtacagtggtctctgatgtccctttttataaggacactaatcctgtttgatgagagcctgtcaccattatgacctcgcttaaccttaatttcttccttagaggtctcatctccaaacaaccacacaggggattagggcttcaacatatgaattttggggagatacaaacattttgtccatagcagtcataaaaatgtcagtttggattaactctaaaataaataatgcattgttttacttagtaagaaagaaccaatctctgattctcaaagcttgggttctcatcagcaaccgaggccattgagtcaaatagaaataattacacattcaagatgttatctaaatatgatacaaattgaatattagcgtaacctactgacagaagcttgccttgttaacagtacttacttacaaaaaaaaaatttgagtgtcttctatgcaatacccaatatattaggaactgttattaaatgaggtataatgatatgataacaacaagccatatggttacagacatacttcactagctgttctgcaggatgagcatgaacagtagcgttgtataaacaatttagcattgccaaaatgaagtagtgatttgaagtgattgtatggatatatcaaaataaaacttgctaaatggagtaagacaggttttagcatgaattaacgacataattatttcagcttatactttagctaccaagtcctggcataggtgtaataggatagagtgctaggaagcacaagcctctaaaagtgagaactcagatgttcaaacacagaaacccaacaagcctgaaaaatattgccctacgagaaattagaactccaaagagttgctttccaaagttaaaatttctgtggtacaacattttcattctcatgaaaatgataacttcttagaatggataccaaaaaatagcaactgggcacagctggatggctgcctggtctttagtgcaagagtcctgatgtttttcagacaagaggccagttgttattgagtttcagagagaaagaattatttagtgcaggtatactccttacccatttgtgtatatgcacgttttatgtatagctctgttctataactgagagcttatgacagagagtcataagtctcttgaagaagcaggaagaagaaatgataaaagggaagccaaggaaagccctgcctgacaaatagaacacctgtcaggtcaacgttccatgggatctaacagtacacactggtgcaggcccaattagctaggcaaatgatttaggtattaaagggacataagtcatgagaacagagtgttggtcaaagtcaagtttaaaaagtgagactttccttcactaatgaaatatttcctaataaatttcctaataaaatatttcctaatgaaaaaggtaaagggtattaagaatctttgtttttatttatttatgtattagagacagggtctcactctgtcacctaggctgcagtgtagtggtgcaatcacagctcactgcagcctcaaactcctgggctcaagcaatcttcctgcctcagtctcccaagtagctaggattacaggcacacattagcactcctggttaatttatttattaattttttttttttttttgcaagtacagggtctacttatgttgcccaggctggtcttaaactcctggcctcaagcaagcctcctgccttggccttcaaaagcactggaattacagccataagtcactacacccagtcaagaatcttttcaaactgatacccgttacaaggaattttaaccacttggactgccagtctgataaaacttctgtaacagcactagcatgtgaatttttgtttgttttttaaacagagctttagttacgtagatctgaaggaacgagatctgtagaaaagccatttgatccagcactcaaataacagttcttgacggaaagaatgaagttctaaactataattattagccaaaatgtcattatacattttaaaaatcccatctttccagacaaaatagttggaaaaaaagaaatgaatccaataaagcattgtctctaaaaaattcattggtactgctagcatgatttttaacataattcatttaagattttataataggtaaactggacataggaatgctgccatgtttataggccgctcaataggaaagatgaaactcatcaacaaaggcagacatattgcagccacctaaccttgtctgccacataatagtttccctataaagatttgttgatgcattgactgcttggtttaaaggccctaatagtacagcattaatttcttatgaagtactttctaatatcttgcatttaagttttaagtgtaacctttgctatattatgggactgactcttttattgcattaaaactaacggatgcatattgagtaattagctttgcctttctttctatactttctcttaaatctttataagggatagcacgggaactatatttttatctccaagtttgcctccaagtccagctgtgtagtgaaagggcagcaggaaacttcatgaagtatgccttcagctcagagtcagaacccgcattcagaactttgctggggatgagagaaaggtcaaacctgtgggttaaaagagaaagagagagagatgagaaatttacagatttttatgaagaaagctacaataatttgtgctctggacacagacggacttgggttagggtcctggctgtaccacttaacctacataggcttagtttctatattaataaagcagggctgatggtgaatataaagattttaaaggctctagaatatagcaggcactcaaaaaatgttacagttattattccaaagaacatttggtgacataaaaacatgaggataaatatcatccaggaaaaatggaagattctgcgtaggtgatagtccaaacaccattcagaaagccagtgcatgggcaaattgctttggagccacaaaaagctaggaattaatgacgtcttgggcttcaaggaaatagtggggagctgatctcccacaggtgtgggagcctatccaaactctctgttttcctccgtgtcctctgactgatgcccaaatccaacctggatgacttgtcacacctgtgacactagcacccacccaactctgatactcaccagtttagcaaggccctcttccatgttcaggtacctaaactccagaccccttgggacacactgacttatactttggggcactttgtcccactggaagaatatgggagtagggagaatagagaacaatggtaagagaagcttactctcccagcctcatcatctccggctttctctatcactgaaccctttcctcatagactctccaggtctcatgagcttgattaggcgactcatgaaaaattctcattactgaagcctgagatttctcctttgcctgccagtcaccctctgtctctccagagtcagaacgtttgcaatttccatctcaatgattattttaacaagtgaattaggtttgttgcccactctgtagatttaggaaggacccttatctatgagtgatttcggtctcacatcccaaaagtccacatttctacttcagcaggccacatcatgtttgttccatggttcagaatatctgaacttttagtttagaactggctggtggggacctggagttcatgcaggcagtctgctctggagtctgcgtccttattcccattctagtccacatccctctaactagagtggatggggaggggagaggaatggaacaaaaaaggtaggttaaagttggattgaatagaatcttgaaagctaaaccaaagaattagaatcttactatgtaggcagtcggaattcagagagattaaacaaagtggtttttgaggaatagtaattggttggcagaacacaggattgaatagaataaggaagatattaaaagattaagagactgtttagaaggtattacattaatctaggtttaacaagatgaaaactcagcctaggaggtaacattgggaactaaaaagaagtgatgggcatgagccagttaacatcagcatgacctggtgggtgattggagtggagagtaaaagcgataagtctggttttaagagtagatgatgaggagatctaattacatacacacacccataactaaggagttgtatctgataaattatttaatctgaacctaaatatttttattccttaatttaaacctcctcccttttttatcttcagcttaaacattgctgtttaaatcctccttaacactttacgcttaagactaaatgatcctgatattgttttttctcattcctccacttcttaaatacatatatatatatatgctaattaatgggcagagttggtatgcatgtactgtctatatctctataggtgaaagcaaaaaacggattctggagataaaaataagaatgatagctctcctttattgaacacttattatgtacctacttctgtgctgagctgctcatatgtattatctattgaatgcccataacaaccctaagaaatagataccattattgtcttcatttgcccaggaggaggctgaggcttggaggagtataagaacttgctgacagtcataacatctgaaggggattagaatatgtcacgccaaaatatgccactttggcataataattattttaagttgaaggcaattgagaaaaagcagacacaagaagagctcttttccctcccctatctgcctaaacatagggcataaagctttcttgtgaaagtatttccccaccttccatatcaggaaagggataacaaactgtaccactggaaatggagacagcacctaaataagtctgtatagacaaaccttactacataacctttatctagcagttaatttcccccatatatttaccttcccacaatttgccactcctagaaagccaagcccctttcttttgtgtagtcacttctccataatttatcactctttgttaaaatggtgtataaggccaagtctagtcacttctttgggctgtttccttctgtttcttcaaagcccatgtacatgtacaaagattaacatccagtaaattttgcatgcttttcttctgttaatctgtcttctattaatttaattcacaggccccaactacagaagataagagggcataggaaaagtttttcctctctacaagccaaaagtcgcaaggctaatatttactcccctgattctctcctccagagcccacacccttcatcactactgataaaggtatgataatgaattctaaattcctttcttaaaatctgctaattgggtaaagaagtaaagaaaagtttgatattctcctccatataatggcttatttatagctataacttacttgtcaaatacaaatgctaccgtggtactatttatgtgacacgtgatccaaagactgttaccacacactacactaaaacatggatatgacatatttcctgtgaagaagaatttggtatgatttagaaaatcttgaatcatattcaataacttaattttttatccaggatataaacatataattgtttcaaggtataaactcctgtacagaatgtcagtgtattatggcacaccccataaagagactgtaaaaaacaattatagttttatgctcaattaaagagacggaaatttttaaaaggggctatgtcaatcagaaagaaaagtacctagggctcattaatttaaagacagtaattgatacgctggcttcaggagtgtttttcatattatcattaatcaactcttcatttgaaaaacacacacgagggaattactgaaagagtaggtatcacatttaattttttccactatgtttttcctagtttcaaatatgtttttcaaatctggcattcatggttgctactgcactggaataatggtaacaacaggctgatgagaatcttaagtggcacttactcagtggagtaattggaagcggcaatggttatacaaatgaatgcccctcagagggaagaaggagagatttgccttgaaactgcggctgtaaaaagttagtgctggtaagtgaagaaacagaaactaagtgatagagaatgggaactaaggtagaaataactaacaaagatcactgtgcagaaccgtagtggtgttcagagtagatgcgcaagtccatatgcatgtagcaaatacaagtctcaacccacaaaataaagtgaagatgaatatattttaattttgttaataaagttattttaatttctgttataagctctcttccaccaagacagaagcacggtcacatgcctgggtaaaaagaatatcccagatacccaagactagacagcatgcaggggtgacaggcttattaacttcacactcactgggccatcagtactttacttataacctcattcatggttttgaagttttaaaaaaatgttgccaccttgttattttgttactcctctcttataagtgattttcagataagcagaaacacattaaagggaaagtttatttggttcatttgcaaggcagagtccatggatttcttttggctatccctttttgcactttcaatggaacaaacagtgcaatttttatcccttctgtttttagagcagcagctgtaaaagtaattaatggctaaagagactctagcacatcctactgaaaggccattctgggttcagcaggagctctggaccccaggctcctgcctctgcacgttcacagacttgcagagagcactctgatgaatgctgaaggacccccctcccaaacttgggatctccgcagcaccctgatccattttgaccactgccacttataaagaaaactggtgtcaacaggtgttttcatactatttccagtgatgactttggtgcatatccagtattcttttttttaatctctgggagttgacaatgttctcatgaattctattaaaaaatgagcatttcccctaatatgttttctcttcctttcagccttcactttcttctttttgtctctaccttccttaaaatagcattgtgcaaaaacatccctgaggttaaataataatcatgtataatgaggaagcgttctgtgtgtgccctctgcagagtcagaggcctgatgtgggactgaaaacacaagctggcctccaggcctggtgagggtcatgctccctgtgacctcgagtcaattgctcgacactttggattctcagttttctgatctttaaaataaggatgacagtacctacctgggctacttcacagtgtccttgagggatcatgaaagtgagtgtattttgtaaactgcagtgttccatagggacataaggaatgttggtcttattgattttgttagaacaagactcttcagaaacagtggtgagagagaggaatcagtccgggattcctcttttccatctcattgactcatctgataacactgagatagtggcttgctgctgcatattccctagcggactgagagaacacacatttgccaaatatggaggggaagatgagctttctgaacaccctcctattgtctgcactggagctaagccaggccacatcttcaggataatgatctgaggacggtcaggctcaattcattctgcctgagctttgctgctgccccttcaaactacttacgaaagtggtattaggttgtgatggctgctgccccacccttgggagaatgcccaggggatgtggactgccctaggcagccacaggaaactggaccagaaagtgcagagtcactgtgtgcccaggcgcctgcaggcagatctttctccaccacatacatttttagtgggccctctcacaaatgcctgatatttaacatttgagaaagtcagcaaaatgttttgttagtcttttattcaccattttaagaatataacgtttatccagttggtgtcggataaaatcgggaaagaaaaatatgactgcactatagactcagggcccaaaattattctgatgatggccaagtaaaaacattaaaagctgaaaaatataatagcatccaggatattactgaagattagttttaagcttaagtttttttccctcacttatccagatttgagtatgagaagatttaaagaattctataaaaactgtgaaaatgcatctgctaaattaataacagtatttatttcacaaaaatgtcctaagttttgtaatgcctctaaaacaattctcaaacttcttggtctcagtatccctttaaaattcatacattacttaggaccccaaagggcttttgttcatgtaaataatatcaatatgtatttattgtattaaaagttaaacctgagagtttttaaaaatttatttactaattcatttaaaattaacaaaaacaaacatactacctgttaacatcagtgcaatgatgtcgtcatattgatgccggatttcttgctccttagctcagctaggtctgggttcttgtctcatgaccaggaagaagtaggcacctgggcactcttagagtgagcaaggcaggaaattttattgagtgatgaaacagctttttcaggaaggggacggggatggtccccctatccaaaggcaggagagttctcaatataaccgagcccagggctttttaagggctcagaatagggagtgtgtgctgactggtttgtgagtatgcaaaaaaggtcaaagcaaagatgccactcaaaggtgggcacgacattgtagaaaatcaattaggaaagggtaggtatgtgtaaaatgggtgaagggtggagatcaatcagaggaaagcacaccaaacaggaaagcgggttctcaatctggttcgaggagttaacttgtagcttggctttcaggctttaaactgtctttggcttggacgtgggatttcgctggggacccgcccctacatgcttaggcatttggctgcctcctgctgctctcaatatttcatatagctatggaaaaactctactcataaggaaatgagagtgagaagggcaaatgacttcttagtgcttgcttgtcaagggcttgtttgacaatgtttgctctaaaatattttgatctccatgaaaaaagtgttaaagaaaatgaggaattacaattttattatcctaggatttttaaaagtctgtttcattgatcttaaaaagtatatttgtattgttcaaattgtgggctatgagtttgaatcctcatcctgtcatgtactggttgaatgaccttggacaagctatttaagttttctggacttcagtgtcctcacctgtaaaataaaaatgataattgtataccttccccttggggatgttgtgatgagcaaattacttaaccttatgtatgtcatggttgtctagagggaaaaaaacatatatataaaatattggatatgttctatatatgtgtgtgtgtgacagagatacacacacacaaacacacacacacacacacagagatttatgttaaggaattggcacacgttacggaggctggccagtccaaaatctgcagggcggactggcgcctggagacccagggaaaagccagtgttgcagctcaagtccaaaggtcatttgctggcagaattatctcttgctccagggaaggttaatcttttgttctgttaaggccttcaactgattgaataattatggagggcaatttattttgctcacagtccaccaatttaaatgttaatctcaaaaacaccctcaaagtaacaaccagaataatgtgattacatatatgggcaccatgatccagccaagttgatataagacattttcgttgaccaaaaaagccaaactctataaaatatttgaagatatttattctgagccaaatgtgaggaccatgatctgtgacacagcctcaggaattcctgagaatatgtgcccaaggtggttgggttacagcttgattgtatacactttagggagacagaaattacaggcaaaaacataatacatataagattcacattggttcggcctggaaaggcaggacatcgaggggggccggggagtgtgacttccaggtcataggtaaattcaaagatttcctgattggcaatttgttgaaagagttaggttatctaaagcaagcttgtccaacctgcagcctgcaggccacatgcagcccaggacagcttttaatgcggcccaatacaaatttatacacttaaaacattatgaaatttttttgtaattttttttttttaagctcatcagctatggttggtgttagtgtattttatgtgtggcccaagacaattcttccagtgtggcccagggaagccaaatgattggacactcctaatctaaagagttaaagtcagcagaaagaaatgcttggggttaagacaaggggggctatggaagtcaaggttcttgttatatagatgaagcctccaggtagcaagcttcaaagacagtgatcatggtaaatgtatcttatcagatcttaaaatgtgccaaactcttaattaaatcactcaaggatcaggaaaagacctggaaagggaaggggattctctacaaagtgtaaattcttcccacaagagatagctttgcagggccgtttcaaaatatgtcaaagaaatatattttggggtaaaatactttgatttctttcagggactgccatctgtcacgtgatgctatactagagtcaggttggaaattggtatcttattgctacaaagagtctgtttcctcagtcttaagatctctgttttaatgttaatgtgagtcgatggtgcctgaattccaaaggaaggagagtataacaaggcacattcaaacctccttcccatcatggtcagaactagttttttagatttctccgaaatccctttgactgagaggatggggtccattcagttagtaggttggggggctcagaattttatttttggtttacactttgaatggtgcccggcatatacaaactctaaacaaatgttatatattcttaatattgtattgaatatatattgtttttaggtgttgcatgaaaaaatcaagtaatacgcaaagcaaatttttatttttatggagaaaaaaaccataaaacccaggaaacaagtaataaaggttaacatggctttttatacttaataatacttcatattttgaattaatatataagaagattcagaaaaaccagtgggaaaaatatgtaactgttgatgaaaagagttaaactccgtacaatatttgaagagatttattctgagccaaatatgagtgacgatggcccatgacacagccctcaggaggtcctgagaacatgcatccaaggtggctggggtacagcttggttttatatattttaggaaggcatgtgacaccaatcaaatacatttaagaaatacattggtttggtccagaaaggtgggacaactcaaagtgggaggctttcaggctacaggtaaatttaaacattttctggttgacaattggttgagcttgtctaagacttgggatggatagaaatgaatgttcacgttaaaaataaaggattgcagagaccaagttttattgtgcagaggaagctctcagatagcagacttcagaaagaacaggttgtaaattgtttcttaccagacttaaaaggatgcctggctcttagctgattgtcttctggatctggaaagaaaggaaggaaaacaaaggggaaaagggattctctacagaatgtggttttttcccacaagggactttgcagggcaatttcaagatatggcaaggaaatatattttgtggttaaatattttttcctcatcttataatgttatgccagaatcagattgaaaagtcacaaaatatagggtcaaatgaaatccatctgatgagaacttatggtttgtagggcatgactccctagaccccttaggtaggaatttgggtaacataaaaaaatcagagcttagtcctcataacccagaaacaaatcttatcatatacagtgatatgataaaaattggcatcacaatgtgaaaggtgagttaatcattcagtaaacagtgtttaaacaattgttaattatttgtttaaaaaaattactttatatcatcactttaaccaaaaaataaattccaattctatttaagagtgaaatgctaaacatacacatacacacacacacacacacacacacacattacagaaaataatttataaatttatctatatctatatatagataaatatttagcttatctttgggtaggattttaactcagaaatcattggaaatattactaaaacattaaaacattgattacattaaaattaccagtgttaaaggtaacaaattgtgaaagaacatctacgcaaatgtaacacagaatcgttagtatatgtaaaatattgcaggcttacataaattgataggagcaatataagatcccactggggaaaaaaatggcaatggtatcatcctggtctgtcagtttcctttgagtcacaaggataatagaagtacagattctttaaagtaatggaaatttatgtagaattcctcagaatgcagagttagagagaaaatcatcccttaagtaacagtcatctgggaccccaatgtcatcttaactgggataaagtgttggcttcaaagacaattatgagaactgtcttgtttaggacaatctcttgtttgcctttcatttgtacttcataaaaactgaacatgattaaattgtttggtaataatagatggattgaagaaattgattcatgggaatacattttggactagatttgtcacacccacaaatgaaaaatggatattttctagactttcacttattttaattgatgcacaatggcttatttaaaatgtttcagccttaatcctccctctccctgctttttgtgagattttctggtctcaccaactacagttctttccaggtttggggatggaaaaagcgtggtaccttttcatcccatcataagggtcacagccaacactcctataacaaaaaacaggttaacatgagaaaagcataacacatttctttaatcaaagttttatatgacatgggaggcttcagaaatgaagacctaaagacccagggaaaactgtctatttttttgcttaggatcaatgaagaatggacagccatgtagaaatgtgattggaccaaaggttgtgatctaatggtgataggttgcaggggaaacccagcaaggcctgactgttcagattcttcttggcctctttgtgtggtatttctttctcctgggtatgcagcaggacccctctggaatgagggtcttatgacctgctttcaagcaaggtaggtcagatggcttccttgtggccagctcctacacagaaagtttagagcaatatttctagtttctatgacccaccttgggaaagaggaattctagtttctatggcctgccttggggaacaggaaaaagaaaggcaggagaaagtcagagacagactttgattctgagacccttccaatgtccttcggtttaaagcactcagcatgccaaagtgccatgctgaggtggttcagaaaacccccaacacaggactgtgagctcatggctggtggggacttactgtctatgtgagtctgtgcctcacacaagtgcatcacacccccatgcctcaacaccacatgtaaagacaactcccttgaaggattaattggcactttaaaaaggatgttggaacagagaaccaaattccggatactttctttcccctactatttccacaagaggcaccatgcaggttgactcttagccctggttgtcccaaaccagaatgaaaggtctggcttgactcatggagattagcttaggctgctgggcaaaagaaccaaaccctggtcctgactgttgcattggagccttctgtgtggtctagtggagaaaatacttgctgggagccagaaattgagatctgctccttgtccagtcttcagagcaggtggcggggccagctttgccagagtccaagtggggcacttatgtttgcagccttcagatttccctaaaaatagcaagacctctgcatccatgtatcttttggttgagtctcagtcacttgtaagcttcaacaattaaatttacctccctgaacctcaatgttctcatttataaaatggaagaactgcttacatcatgccccttaagaagattaaataacattgcactgcgcacatagagcatgtgtttggtgtataataatctcaagaaatgaacttctctcccccttaagcttatgtcaccatcttgtttcctaacagatccatttttgattaattttcagacaggaaaggatcatatatattcaaatggtgttttattagctaataaggcaaactaaatgttctctcccaagcatattggtattttaatatggaaaaatgggaaattatgctgtcatggtgatacctgaggcagcgaggagaagccaacaaggactgtatccagagattcaggagaaattatccaagaattctttgcttcatagcatttttgaatcaatcttttgatttaagccttctgaaacttaacttgccaatattttgaaaagtgaactatcaagattgttgtcaatcacaccctagtgtggtttaactttcagatccctttttggaagggaagttttatttaatccatgtgttgagaagaggaggatgcagttcatataacctggatatttagagtgaagggagaaagaagatacagtgaatatgaaatgaaactttcacataattcacacatgtacccagagttgcaaggagaaaacaaaagtattggtacataagtacttttacgtgaaatgatttaaaatgtttgtatatggtattttttgttgtagtttctgagatggagtcttgctctgtccctcaggctagagtgccgtgccacggtattttaatttatttttctttattttgaatttctctactcaaaggtacattttaaatacccttaatcatcatgatgatcccacacttcctgcagattcccatagaaagtcacacatcttcctcctgttgaactattgctccacaaatcatagtatttgcctaggattttgctttttaaagttccattgccacatttgtggtaaattctattgtgtatggtaacacatgataacaacaatgcgtagcgcctaaaagctctaatgaccagcaattctgtggtcagtaaaaggaaattacataacattagtagccaatatgctgttgagggaaaagtcctcacatttctcctgaccatccctgcccctgtcacttgccactaatagtaggttttgcaactaggtttgggggtgagtggaccctggagtactattctctgtacccccaaaccatgcccaacccttctacttggttatttcaactcagtggtggtcaagttttgttgtatttaactcctacacaacttcactctgtctgttctatcataaaccatgtgtgtctagtactatcaagctaagcattttcattattactttatttacataaaacccttttaaaagaataatttgacctaagatacaggtcatcctggactttccaccatgtatgtctgttagtggtggtttgtcttttttgggggggatattttgttttttgtttgttttgttttcaattttttgagtatttactatttaaataaaaagcaatggcagcaaaggtttctatttccatgtccctttgagctttttccttgacatccacttctctcacaaggatctggccttcatgccaagtctctgctgatcttcactgcggagggcagctcctcccaggagagggtccagcccctccattggctggtgccggcctcacatttgtcctgaccctgtgtctggcttgtgctgcccgtgattatggctcctgccggccgctcagtggcccatgggattgtggagcagaaagcagaaaaggaattttggattacgggggggaaatgatgctttaaaaaggcaacagttttctgatgtctatttttttttcattctaagatagtttcataaatttcctcttcatttcaaccaagtacgcttggttacacttcctaaggaattttgttcaactagatggtatgttttggtgaattaatccaagaggacgctactgaaaaaatattatatatatgcagctttcttcacagaacatataacaggatatatatttgggatgttaatttaaaaaacaattttaaggttaaggaatgatatagtgtgctagattaagatgtattgagcaagtcatgctttactttttgttcattttactaggtcatttaaattccttttatgtgctcctcagggcagttaactctttacatgtttgattcagtgctggaaaggctataggtattgaaaggctctaaaaagttaagtgattaaataattatgctcattatctttatcatatttgatgttttaaatactgctaataattcatcttactttatttgcactaaaaagctattcttggatttaatatttctagtaataaaaaaagcaaaacagatattctctcatttgtgttcctcaaagttaattctttattatcttccttctcctcaaacatgaagttttatcaacggtgatgcattttcttgtgtgtttcttactctatcagacttgatccagtcagactcacacacctgagatgaaacccaggctcctggaagctatgaaattgttcagtaatgtagccttataagtaagcaattaaagcaggcctggagtccagtaaggcctatgccattcatactggcaacaggcgatgtattttccatcactctttccccttgcccagatagcttctctcaaaatagatggtatgttttattctatcaagcatttatattaccttttccttcctagccattttaatggaaatgggtggagaataaacagtaactcaataagaagtcataattgctcattgtagtacatcattgattgtgtgattttgtaatataattgttattgggctcttattgactggattctgggtttctcctgtccttgttaggttttgtgttgactattttctctttctatttttttcctaagacttttaaagtgtttctcaaattatggtctttgttaaactttctgcatcccgtaatgtggatgttcaaaagattcctggtccccactccctacccactgccaacagaatcagattctctggaagtgcgagctagaaaaatacattttgaataagtactcctcccctccttaggtgcttcttatgcatgctgaagttataaaaccattgaggaaaatagacccaccagcatcatctgaaacacaattatccttccaattgtgtttttttccccctacactttctccttttttttaatctatcatctcttccattttcaagacgatttgtgagtcaatgtaaatctgtattgctgggccctatccaccaaatctacatccagccttagacattaccaatatcaggaatcatctatggaaagattcaggcttattccatagccataaatcctggaaactgtccttagtcatttagcacagtcttagaggaggcctcggcattctgtggctagtattacaccatcctttagcatcatgaatgtcaaagttgtgctgagatgaagtgaaatgtacctgaaataacaaaaataaacaaaccaaaactacttcctacttgttgagtttctcctacttccaaaattactctgtttccaaaagttccaggtcctacaagtgctctagattctatcctatgcctctttcccatgaggcttttggacatcttcaggctgtagttctttttcctactcccctacccttagaacatagtaagtagttaaatatgttcttgttattatgctcattctcattgtgttatttatacatggcaaacacaacggtgtcttgcacatgtggtctataatctataaattttatttatcattataaataatcttcaaaactatattcaagtaacatcttgggtaacagagcatatcacagataaactgtgaaagcccaacacctatttaactgatttatcaacatgctggtggatacttaaaggatttggagtttactacatattaaagtgtatgttatgttattatcaactcaaactaattaataaaattagccaggtgtggtggctcatacctgcaatcctagcaacttgggaagctgaggcaggaggatcacttgaggccaggagttcaagaccagcctgggcaacatagcaagaccgtgcctgttaaaaagtaaaaaataaaataattagccagatgcggtggcatgcttctgtaatctcagatattcaagaggctgagatatgaggattgcttgagcccagaagtccgaggcagcaataagccaggatcgtgccactgcactccagcctgggcagcagagttagacccagatccttaaaataaactaatagaattttcatcaacctagttcttcctattctggcatgaccagttcagaagtttctgtcctactttagtgtgtaatcatattatttaaaaataccataatttttaaaggtgggtgtttggtaactctgacatttagtggaaaaagatcaaaacaaatccttccttcgattctgggcaactaatgtccacccatcctatgacttttatccagtctggcccatctgcatacttggctagcttttctggtctcagcacgggtaacttctctgttgagaaactttcctcatccagcaaaatctaggtttggggaagctcccacaggctctcacagcattctgcctcctcacaacaccaatgacatttgtcactgcctcctgggcagtctctgaatctaaagtgtttcatattataacttcagtaccaagacaagagcctggaacacaggtggatgccttgatcagtaaattaatgcaacctgtacatgtgaaaccaaaccctgtatactttagcatcatttatggcacagagagccctcttcgctttactctgattaagtggccattcattctccttttgtttggctcctgctcttttgttatggcccccagtttctgcatccattctgcaccatgaatgtatcagttaatttcagtaatcctggtcccatcttctggagctctcaggggactctggttcaggctcaacactctagagattcccagttttcacagctttagaacaatcccctgctccagcctcttaagccaaaccctgagggccccttaagagagaggaccaaacactctatgtccttatgggtgttttcaatctagcattctaacctccttgaaatcataaaaacacattttttttctttgattcattttatctaagtgtcttggacatttccataaatggatctgttgacaataactatgaacatgttttcactgaaactatctcactgatgagtatttggtggctttagaaagagaaatggttgaatattagcatggggtattaaaacctgaaggttaaatggatgaagaggacttgaatgaccttactgaggcaacaccgtgtgaaaaaaaactcttaacattttttaaagtcttctatttggtaggtccacagaaaggcattcatcacccagaactggcctttggaaggacacagacttatatttccatattttcaatcacaggtcaacaaagtttccagactttccaaaggtgaaaaactgtaccttaggcttgttgagtagttagagcagaaggaacaagtttgtcatttgactggtcagtaaacctgtttggtgtctggccagaccaaaaatattttttgaaggggagttctctttgccatgttattcttagttttggcccaaattgtcttttatattttgttggcatcaaggtgggctgccaaggagaagaccccagactctgagcagaccgctaggcagaagcaattggaagaacacaatgagcccttgatctgaaagaactgacagaagaattcagggagtgacaagagctgcttctatccaggagggctagtctgaatgcaacgattaagccatcctggggcacagtgcagggcgcttggtattgattcaatacatttttaaaaaaataagtgaatggggccaggtgtggtggctcacacctgtaatcccagcactttgggaggccgaggcaggtggatcacaaggtcaggaaatcgagatcatcctggccaatatggggaaaccccgtttctattaaaatacaaaaattagccgacatggtggtgggcgcctgtagtcccagctactccagagcctgatgcaggggaatcacttgaacctgggaggcggagtttgcagtgagccgagatcgtgccactgcactgcagcctggtgacagagcaagactccatctaaaagtaaataaataaataaataaataaataaataaataaataaatatgtgaatgaatgagaaattttatttatgttaaatttttgaccagagcatatggctctattactgagccagtcggaaatggctcagaatccagcagtcagcaacatcatactattcagggtcttcaaatacaccctccagtttgaccaacaattccaggaagtgaccagcaaagtctgcctttatccccttccattaagcacgtcaaggccagttttgtgaagcagttgattacaatccccaacctcaagcaaccagtggagaaacctgcagctgaatcccttgacaccactgaatatgaactaaggtgttgggcctggccttgtctgtcttacccttgaaaatgtacccaagagacaatttggttgggactgctgctatttgggagacctgattccaccctgggtagattttttttttagacggagtctccctctgtcgcccaggctggagtgcagtggcacgatcttggctcactgtaagctccgcctcccaggttcacgccattctcctgcctcagcctcccaagtagcttggactacaggtgcccgccaccacgcctggctaattttttgtatttttagtagagacggggttttgccgtgttagccaggatggtctggatctcctgacctcgtgatctgcccgcctcggcctcccaaagtgctgggattgcaggtgtgagccaccgcgcctggccaattttttttaagtgaaattaaaggcccctgacttcaggatgggagtcttctcttcttactgatgggccagcgttctcagtgcactgtctttgtggcaccatggctacagatttgctctgggctctttgtgctaataaaggcgaagggctagaaaagatggaccttgtaacatcttaaaggctctaagagacaattctgcatagggtaagaaaaaggaaattggacagctagacctatggttcttactccattcttaaagtggacttgttccttggataccagggaatacaacattgacatagtatagtccaatggctaaaagtgacctttctgaggagcatgatgcattcaggatacttctgctttgtgttaatgtttcttcccttctaatctattatttccaagctcgcagatcaatgaatagctttactatttaagattccagttgaagggggggaaggcaggaatgtaaatttgtagggaggagggaagagcaatcagccactctaaggtcccatgggagctggcaagcactggaccacagaatggaatgggatgtgctgaatgaagctctgtctgtcttgtacacaccagtcactccaaggagggagccaggaagcaggcggcagggtatgtgggctgtcagagtagattctgctgagaagacatgtgtaagggagaactattgctttaccagaagcgttgacaagaaatagaagctgagatgtcattgcaaaatagaatgcacccagagtagcatttgaatgtgaatgcaatcattggagaacctacggagaggccaggacaaaggagggaatgtgtgaagcttgtttgagagttgcgagtgagaaaaagttgtttgctgcgatgagttgacaaaaggaggatttttaaaaaacaactactactctttccaagggtgaccagtaactatcttagagaggcaaattttatgaaccaggccatgacgggaactgaagaaaatgcctgccaaagtcaaatgtctaaagtaaatatacttttcataaagaaagtacatagtatttgtgcattttataaaatatattttataaagaaaatgtaaagtacataatatgtgcatgtgtgtatttctttaaagacttatttatagaactagcaatcttagacttttttggtcaaactctttggtcatattagactatttaaaatacaaaaagaaataggcatattggtgtatatacaattttctagcattgcttctctaagtattctgtttctctgtcagtctctctctctctctcacacacacatacacaaacacacacacacacacaccatgcacaactattagcagaactgttgttttgcaaaagtttgatggtttttacttcttggaattgggtcctaccagtttgtctattgcccttctgggaaatgtgtccacctgtcatggatgaaaatattgcaaatgtgtcttctgtgttaccgaaagacctaagggggtgaattctattttgtaaccaagaaaagactagagccagttcttaaatgcttcttctagaattcaaataaaaacttagaacatatctactggccatgttgttctaattaaaatatgtcaatattaatgccaactattaccgtgggtacccacacagaagaaagtcaccaaaaaatgtgtgcagtttccatataaaggctgtttttatcactattttaatttaaaatggaatatggagaaatgcatgaaaataaaatgctgtttctaccttcagtatttatacttatcactcttggtactttttctagaaaccctttataggactcttgtgttttcctttccatcactctcctcactcctccagggcacccttttcttctgaaggccaacttgtggaaaccccaggagctagctaccatgttacaggaggctgaccatcatctggactctctcttatgtcagactgtggaatgtaaattttggaagtgccaggagctatagtttctatcatgtatacaaaacttctctgaagtgagaaagactgcaattgacataccaagaagagcacagacaggacacaaaggtatagtcttgtcagtgttcaagctcctggtcccacttatttctctgaattactacccatcctgggatttaattgtcctagagttctttgggttgcatgagccaacaaatgcccacttgtcctaagcaagtattgcttgggttttccatcatttcatcttctattctattcagaagattcagaagatttaacaaagtcctaggtatgaataaggaaataaatcttaggacagattatttccaggagcagtaattagaaatattaagctgtagccagacatgtccatggcatgatgtatagttaggatatgtaccattgaccacaacacaggtatggtggttttaaaaaatatgttgcaaattctttgacactgattctcttttcattaggtcagatctaattccttctccttttgactatggacttgacttagtgacttgtttctaacaaataaaatatgagagaagtgatgttatataacttttgagactaggtcttagatagtttcaactggctttctttctcatggatcacttgttcttggagaagttaacctccaggtcatgcagacaggcaaagaacctggagagaggcctatgtggagagaaaccgaggtcaccttcaacagccaacaccaacttgccagctatgtaagtgagccatcttgaaatggatcccccagtcccagttaaaccttgagatgattggtcaacatcttgaatgcaatcttatgagagaccatgagccagagctacccagccaagccactcttgaattcctaacccacagagataataaaatgtttacatttttaagctactaaatgtacgggaaatttgttgtataataagataactaatactatgtccaagattaagggaaattactttgaagaggttcgtcaattagcatcagtcataagtgacggcaggagatcccaaataggcaactcagtcataaaaataattggagttcatgattacaggtttggtccccaggaaatagagctccaggtagaaaacattgttaatgaagaacacatgggaatagaatcacttaatcatataaaaagagtgatagaataatataatggctaagataaagagtttgagagttaaacagatttagattcggatcttggctccactagtttctgtttgaacttattacttgtctgtattttttagttttattttgggatagttttaggcttactaaaatgttacaaaaattatcaaaagagtacctatgtactcgtcacccagcttccccaaatgcataagaatttcgcataagaaaaaacaaaacaaaacaaacaataacaaaaacataagaggcctggtaccaagtcccacgagtgactgaaatctcaatttgtattcatagaaagtctattcataccaccttatcctgttccctttttcttggtcctactttttccaggacacctgggttgtcctcttctcccttctgtgccaaactgtcctttcccattgaaaattaatgtattcaggctcacttctctctttaaaagatgcagtcaggagctaagaagccagcctgaagtttctcaacctccgtttcttaacactttagcaaaaacatttccaaaatgaatgaccctcctccatcatgccccacaccaagaaaatgtgagaaatggatcataaatttctcagaaaaatgataattcaagaaatttcaaaatataacaaactaccaatatatgtatcatttaaagaaaacattctttttgctctcacatcataaagtaatttgtcttcaaaacttgaatttgagaactattcagggcataaaaatgaagacatcagagtcacatcatatgtatgtgctggttgcctacccgccttcccatcttgaaggtaagcttcttgcaggcagagccagcatcctgagttctctgtcctgtctctaacacagtgcctgtcacacagaaggcatgttgattgactttgatatgatagagaaatttcctcttaagtattccatttttcagaattcattcaaaagtcaaatacccattctttaagacatcttgctaagaaaggaaaaattcattataaagggtcattttgaacattcagaaggaagacctaagtgttgagtaagtgaacagacctttctgctgatgtacttacagagacagaggtccgggccagttccccatcaccccttacccgcaatgttacaggctcttctcagagctttctccatctgggctctttctcggtagcttgttttcacatgtggctgcaagactgaacacagttaatctggtttccctgccttgctgcacagaaggccagtcaacagctctcttttgacttatctttaaacatttttttaaatgttcattattgaggagaaataaaaaggaagcaacagaggcacaaacagagtgaaacgataaggcctaggaaatcttacattgtacttttaatcatggaccacattctttgtttacccaacttgcctttgagaaggagtgtcgcaccctgtgctgggcatctgatcctgcactgctctgtgctctactgggtttatttccacataggttcacatggccttggggcgccatcatggagggtcttgttctcagtggacatggcacaaggcagtatcctcacatagtaaaggttcaatcaatagttgttgagttagtaaatgaatgactcatatggctaattttttaccgatctgatgggtggatgcaatccaacattgccaaagtgaagggttacacagtgggaaggccgtgggggtggatgtatttggcaggcggcagagagaggtacaggacgatcccttacattgtaaatgcaaaacattctcagtggaatttggctttcccacatagtaattatgtgtcatagtgtatacatgctctatagcttatttctcaaaacatatttgtgggtatgtttttgccaatgctattttcataagacatgtctcacagaaatggccaggagcagccagaagcaaaacccaccaagtcctgtttcgttcttgttctttctttgctaatatgtgcaagacttaagataactgaactcatacttttcctacctagaatagaattatcttataaattcttctgttagtctacaagtaatctgccttgatcctatggaattacaagccagtagagctgctgtattttgcttgagtgtggttaccacttggttggcacacactaaggatatttttgactctctctttgctgacatgagctacagagcctggttgagaaaaccctctgaatgaaaacaaacaaaaacctaccagaacaaattagggacaggggaacttggaagccgtgtaagagttgtgaaaccatcagaacattaggatttagggtgtccctttaaagtgttttagactttctgggaatactccctgggaaatgttgtgttttcacaaaaaagttgttctgtgcctgacagcacgaagaagcacgtgaagactggagactgtgagaatgttttcagcaagagccaatctggtagcaaaaggctaaaaattgcattttcacagctccgccagaatatgcaaaaatttcttgtccctatctattttatgacattaaaaatgatttaaggcaattgacacttctatttcttccaaggggaaaaaatagattttgtagagttctggcatatatcagtgcatgattgtttcagatcattgtagctggaatgggctgttgtaccaaagcttatctaatatactttgttcattcattcaaaaaatctttactgaatgcctgttaagtggcagacactgatctcttactgggtatatagaattcaagaggagagccatggtcaacttaatcaagaagcagttctaaatttttatcaagcaaccatagtgaagagacatgataaagtcaacccagttctaaccccaccactaaagattaagaaggaaatattttagtatatgagttaggtaacctggttattagtcatttagggtatgaaataggacttggaaaaggttattaagattttgaagtaatagactgaaacaatcagacttgggaaagaacacagatctcatttttctggattagctgcatttggttgcttgcgaggtgaagctttagaggaaaaggaaaaaggaaaagcattttggcaatcaggttacatgaatagcaggtttcagcagatctaagtagtcccaggcaggctgggccagaatgtccttagataatcaagtgcggctttactggtatggttattatcccaaaggagacctactagaacaggctcaactctgctgctgtacagcatgacctttggtgctttctcttttttatttctcctgtaggaggcaagagctacagcttaatggataagagcccatgctttgtggccagccatgcctgggtttgggtcctgctctgctacttaccagacagccctgtgatttgagtttcacagcctctctaagcctctgattcctgcctcataaaaagggcatggtgatcgtgtgatacttcatagagcgaaatgagcttagactaagcacttagcccagagcctgacacaaggcaaggatctaattctttctagctagtatctcttgcaaggacatcaaggccatttcttgttaatcaaagtgagccagctggcatcacgggttggaaatcccttagcaactggttagcactcagtacaaactcgcttaaaattggtatattggcagttaggaagttaccactaattctgtcacacttaaccatttcataatggtgatctatttagagcagtgattggaaaacaagaactttaaatttggtaaagaagctttatgttgctttatttgtttcagaaaaggacaatacctgagtcatgttctaagaaaaacatgagcatttttgaaagtaccctatgtggactgaatagtgaaaaaggaaaggcacgtggaaaaggacattattattttaaaatgctttgaaatcacattcaaagtcgtcagctaagtttcgtggtgttctggccactgagggactgccaggctctgtcttccttttttgcccatagagaccccagccctgcagtactggtagtgaggctcatggtagctcccactcactggactcattctgtcattttcaaaagatgttcagttcttaaaataaactgacaataaataacagatcaagtatcttatgatctaaaataattcaatggaaatttggaatgaacataaaactatatagatccccatcttccctggctgattctctcagattataaacatattaaacttatccccagcctaaagtagcctgcttgggagttggcagtctctcaagctgcccttgccccctctgctctcctccacagccaagagtacataagaagtagtcctccctgactctatccatttcctccactcccattcactgctcaacctcctgcagttcccgctactcccttaaaattgctctctacccagctagaggagagctggcagctcagaacttaccataggcttaaaggagaaaaacttgatccagccccaggagagctctacactatcctgggctgatatcaaaggaacgcaactttccaaccccatcagtgttcacccactaccaacccctgctctccaaggcaggaagcaggtgagctgagacaagggatgagatggaagcagtcatcataaaggaaaaaaaaaaaaagtgacaactctggaagtcacaaagttaccagtctcaagaggaaatattgattatcttttataaaaattagcgttcattctccaagaacccatttgtatttggaacaatctgaatctcaattatctgagttccttaaagctacaatgatcatattcacttaatttccataaatagatacacttgtttgctttacaatagcacctaggttttcattagagaaatttcgaggaagcacccctctgtctttaattggcttcctaattacactaattttatttgattgatatattaggctctggaggaaagggaaaagaggggaagagaggtcacaatacagtcctttattctcagctccagacagcacaggaaatcctcaattaaactataccacttccctcagcatgccataaaacccatgcattatatttaatatctttaagctcatttataataatggttttatgtgatgtggtgaagttaactcattccttctagactttcttttcattattattgcagaacaaggcatgcttcttgtgaaaaaaaaatcagaagttcagaagaataagtcctgaaaaattaaagtcccccgtccccccgccccgtcctccttaggttttctttagaaaacttccctgtgacaatttccctccatttggagaggcagacaagaggacatctcctcactcacagccaggacactgtgcatctcatatcgtgctgggactttttcttgacaggattgagggagattcaaagttccccaaaaccagagaggaacaaatgcatcaacacagcatctcagaccctggagaaagtccagccgtggccatggttttgctgtagaatgttttcttctaatgcaaagtctgacttagaacaatgtcttccttgtgccttccctttaaggaagggttggctggaccccgacaattagtaacttaggacaaagccttctgagttggtggccccataagggccagaaggaagtggttttcctacaacctctgttcctcagcccggcctgggccacagcacaggtgaaggttattggaggaagagttgtttcatctgggaggcttttccttcccttattatccacacctgagcagcacacaacctagaggctcaggtggatcatagttgtgggatgcctgtttattttgtggtgagcatctgagaagcgtcatccccacctccagagactgctcagctccccatgaaggggtgggccagttctgtctagttcctccactctcttccctgcatggtatctaggagtggcacttccccctgaactaggaatatctgaccctctgtgtctccctgtgaagcccgttgaggtgagtattaatgtctctgatctgaccgagcagcgccgggtttgcaagctcagctcccaaacagctttaagcttgttcccatccaggcagagaaagggagatgttagagaggcttgggaccaaaaatggagaaagaaggcagaggttcagggcaaaactctatccagaagtgctgtttatttagctgagtattttctctctcagaatgatagatgactattggcggggggcgggggagtggtgggcaggatccctgacaaatataccctcttcatatgccgccgaaacattcttggagattgtgctctaggaatccccctgattctgtgattttccacgtttccgtgactgcttgagggtagaattagaacaaatggctaacaggataccattccttacagctcaataatgctgattgtctctggattctgagtaagaaggaaactgggaaacatcagtatctaagtacctctagtgattgggacagaaatttagacgtctggcaaactttctttttctatttcttttttttttttttttttttttgagacggagtctcgatctgtcgcgcaggctggagtgcagtggcgcgatctcggctcactgcaagctccgcctcccgggttcacgccattctcctgcctcagcctcctgaggcaaactttttatttaaccttctcaaagaaaatttaattaattttaatgactttttagcctctgaaaattatttgcttacaaaattagcttaataataatgattacattgataaagatattattttagcactaaatctgaggggagaaaattaccgtgagtttcaaaatatattatttttgactacttcaaaagatgtttgaagtgttaaaattatttttacagtttctcttacacccagaatattgtattgtcttagtccatttgtactgggacaaaatatatagcaaaatacctgagactgggtaatttgtaaagaacagaaataaattttctcatggttctggagtctgggaagtccaaggttaaggcaccagcaggtttgggtgccttgtgagggctgttctctgcttccaagatgacaccttgtggctgcctcctccagagggaagtgacactaaggtagaagagcaagctcctcaaatgctgtgtgaagccttttttatgaaggcacctgatcccgtttaggcagaaaaagtacccctggtctaaccaccacttaaaggtctcacctcttaaaccatcacattggctacacctgaattttggagaggatgcattcaaattgtagccctgatctgtaggaatcagattattgatatcatgtctaagcggcccattgaaaaagtggtagacatttatctttcttgtgctctttcgtagtctaagtgcacgttgtacataatgaatactcaataaataatgaccagacctcttagacctgatttattagtgatttaaacttcataatttgcttttgtgtttagagaagaaagagaggaaaagttatgctgtttggagaaagcagcacttgagcttaaattctagctctaactcaagtgattttggacaggttagtaaactctctgggactgtatctgcttatcaataaaaggcagataatgatcctactatctcatagagttattatgaggactatgatcacacatgaaaacaccagcacaggacatgttcttagtgtgtacaaaatgccattcccttccttgcccctttacatggtacaattgacctgacatctacaggtattaa

SEQ ID NO: 380 - DNA, 544426 bp, Homo sapiens
ccctcactttgagatatgatgtcactaacctttattgatccactatcagagaactttgcttatctctctcctgtgatatactgcccctcctgtgctcaactagtgtttaatacactgccgggtgccttgcactcctcatcgctcagcactgcagagagaggctgccacggggaccatatttcacagagccgggccttcccagcacagacgcctcccagagtcaaggggagccagcacccacctcccacctcctcccaggccgccaggtcccagctgcaccgagacagtgggtcgggtcagggcagggcaggataggacacggcccctccgggaccctgcggcttctcctttttttgggggagtgtggggacagagcttcagtcccaagattccccttttttccaccatgaagacaactgtcagccatgttcatgtgggaaaacataagcacctccgagtcagacctcctatttagagaaatgagcttcctgtttttccccttccaaggtctcaagacctcagtccaccgggaggtggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctgccacacaccgggtttggggttggtcgctcctcctgccaacccacaggctaaggatgcatcaggcacagccttggccacacccaagggtggggagagccccaaagcaccaacagacaggggacgattgttagaactcaagacacagaattccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagcaggggccctcccacagccccggggcacccaaaatttgcctaattgaacattaacaagttgctacaataaagttcctctgttgtgagcagggaaaccttttcggcaacaacaacagaagtcttgttacaaactgctctgaaagccaggcttcagcctcgacaggtgtgaacaagatttcaacacctcctacaatacaatgcaatccaaacaaaggggaaagtcaatcccagcctcctgaggtttctgcttgtctaacatcttcttcactcactcagcccaggggagccaagtgcaccttcctcaagcccagcagcagagaagacctcaccaaaggtagaccctctccactgcctcaacatggggccatcttggctgcccaggggcagttcggaaagtctctgctaggaacaggagtcctttcaatggctcccacctgctcctgggaccccaaggccccttctatcacctcccaaatgcagctagcatcgatgaaccacactggcgtgtttcccacatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggcaaaggaaaggctattcacaaattttttaaaagtggaagacagccataaaatatgccaggataatccccaagaccggctactctcaactttctctacctccaatcttggagcccacccaagggcaagagtggcctggagactcgctataaaatgtatgtgaccaccacaatggaattgctttgccagacatttttactaatgaatctcatagcacggagacagatcccatataaggagttaagcaggttcattctcctccacgctgccccttcacctaccagataagcaaggcaagtgcccccagttccatggaaggagagcagaccacaaaaaggttagaaggctcaagtcctctttccaggtagctgggaggatgtaattggtgaggcaggagattagaaatatcggcagcctctaagtaagactttaatttactggcagatcaatagagccggggttatattggcaaagtgtctacagctctattgactcacgcaatgcctcttatcaatttatcagaaatctggaagtcagaagatattgtttgaagggaaaagagaaaaaaaaaaagaagaagaaacaggaagcatgagtccagagctagagcagttagaaactagggtccccaatgaccaacttgctaccaagagtttcgtaccaatgtgtctcctgcaaagaaggctaatatgatacatttggagttaacctgcctcccttgcacgcccctctcagccttctcagggattccattttccataaaccttgtaccctggggagggggtgaatcctactgaagctggtctgggatttttgttttgtgttgtgtcttagcaaggagcaattccttccttaggttcagccatactcgtccaagttacagaagatccacacttctccaccccttgtgtggtttcctgctacctctccattctactgcagccagaattcctagccttggcttctttcttaccaatccataaaaagatttctttttaggtaaataggatatttatctcagcatcccaatactcccaagaggtcacaaggatctatcagactaacaatggcacttggtctcaagaagcgtaaagaaaacgaactcaagttctataaatcatcacaaatgttttcacaaataattaatcttcgtttgaaaatgttttgaaatatcccaggtagccgaccaaaaaagcctggcggcggggggggaagtaaacattcacacttcaccaaacccaaatgttcacaccagcgaaggaaggaaggacgcaggaaaacacgaagttcccgagtgtttctagccagtaactctagggggcaggtcggggaagaaagagagggtttggagcattccaggtatcaggaggccaaagggaaaagcgattttccttggtttggaggaaccacaacctgcttttgatgatccattttggtccctgcctcatacaacaaatttctgcttaattgctgttttgcatttcgtggagacatcgagtaaacagtacttaagtgtttccagacaaaaacaataactcactaatgactaaggcactgctaattaaaatgcccccatgatggcgtgactggactcagagccaccacagcaaacagaacgagctgggccttgaatgcatgaaccagaacgcgggcgtgcagggcggaagatcctctgctcctttctctgcaggtcaccacgggccctctggctgaaaagaaggcccactgtgacccttgctagaaggagagggcagaggtgtggagagaatgggaggagttagagtggggaaggggggtgaaggcactgagatttcagagggaaggcagcaccccaatagaatgcacattctagaaccttataagagtaagtggcctggcattgcctcaaaactttatgagctcctgagagcccctaaagaaaaaaaaaatgtgtcctactctagtagggagaaaataagaagatgtgttaaaactggccaaataggctgggcgcagtggctcacgcctgtaattgcagcactttgggatgccgaggagacagggagatcctgtctctacaaaaaattaaaaaattagccagacgtggtgatgcatgcctacagtccgagctactcgggttgcgggactgaggtgggaggatcgcttgagcccaggagatggaggttgtagtgaaccatgattgtatcactacactccagcctgggcgactgaacaagaccctgtctcaaaaaacacaaacaaaagcaaaacaaaaaaacaaaaacaaaaacctggctaaagaccctttcctagtgaccacagtcatacaaggcatccattcctaactacccttttaaaaagaagattcagaaagaacaaaaaaaccagaggtatactcgaccacctgcccagtgctaaaggatttctcaacgccatagtcagacttcacgagcgcatgcgacaaagtaacaggaacctagaaaacttctcttcgtccccaaaaagagaccaaaataactagccttccccagagcgggcagctttcctcttcagtgctcttcaactttcagtcctacagatgggggcctcccaacatcactttttaaagctcagcatttaaaaaaagaacaggaaaaaaaaaaagtagagacatcccagagtccacacgcttgcaaaggactttcttttcctcctcctccccccagcaggttaaagacctgctagttagcaacgagagcggatggaggacagtcattggaaccacaggggcctaatacccatttgtattcacactcagaccctttaagcatataaaaccggagaggttgaactgtttacattcacctaatgctccagtaaacaaatcagagccccagtggagggggtttcaggcagggctgcggccagaccccactgggtgccaggcagcaggagcaggatggggaaggaagaaggtagatgcatggaaaacagaagccaggctctcatcccaacccactcaagtttctccccaagcctgggccctccttgaccccacgcgacaggggagcagcccttccaggcctgagctccaccaccctccatggacaggtgacctcagctgccagacacctccttaccccctacccccagtaccctggagccctgccagcacccccacataacccaccaatgacctggagaggaggacagaagaggaacggccttgcaaagcacctggagaaaaaggggttaaatgcccagtgtctgactgagggagaaacttcccctcccttccaggcgcctccgagggttcgtcctcaactactattgttattcaagaactgcgtcttagctgagcagctcccccgccgccccccagcactgggtcttgacagaagtgaagcggggctgcctggtgtcccagcacagggcctgatcatatcctctaaaacgtgaacagtttcaacttgactggggggaaagggggcaggcggggggtggggggggactggcactccttttaaatgcagatttgaacttttcacccggggtcagacagctgcgatgctctgtccccagcagaggccagcgccggggccccttccacctcacactttcacagtttttttcctgcctgccaggaggccagcctgttaaaggaattcgatacctccctccctccaaacccaaatccacacccgcttctcagcttaccaggggcacaaatcccactggcatcctagaggagagcctcaaatcgtaggaggctggctgggtgctctgggaacagcaatggcaaaggaaaattgttgttgtcacatgtattgaccaaggaacgctaaggtcaacagtgagaagactccaggacttcccggccgctctgaaagcatctgaaagcagcatcttctctagggtacatttcacagtggcgctttctgctagaagccagcagacagttctccttgctatttcactgagaagagctgtaatggtaccaaggctgaaatcatttagttttgaaaagaagtcacttctgggtgaacaagaaaaactgtaacgaacttaaaaaaaaaaaaaagtctaggatgggactgcttgcctccattacacccctgattctcatggacaaggttgtttctgagttttccatgtcaccctctgtccctccatttctcctcctccaatgggagacgcccactggtcctcgactagggaaggtttccattccgcggcatcaagataaggcaagaaagcagaaatccaaataaacactaagagaagaaggcgaggggaagtttcttgctggaatcggtgaccctcccaacagtggcagctcctacaactctcatcttggggggcactagagcctctaagagaaagtcccctccaagcaatgcaccacacagtccctggactagccaaaccggaagcctgtgtgtgtggtgctagaaatgactgtgaagtcagaaaaaccacaccaattacctacaggtagaaggttctagattcatgccttcctcctgccccaaactagcaacccaccacggagagggtgaaacgagcatttctagaggctccctgcagccctgtctgtgatttcagtaatatacatgaagcagtaagtctgttgtaacaaacacactagcactcacaggaatgaatgagagtggggctgtcccctgaggaggtggcccgtgccttgctgccactgctggtcttctgcctctgggaaggttttcacagtcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttctcggatatgactgagacagacttctcttgtctgtcttgaacatctccctaaagctacaatgtactggctcccaaatgatacttttaaatgggctgaacaatcttagtatccaacaactcactgccaaactcaagtataaactaagaaaaaataaatcacttctgggacccacagcgtgcttttaaaaaataataataggccaggcattgtggctcacacctgtaatcctagcactttgggaggccgaggcaggtggatcacttgagctcaggagttcgagactagcctggccaacatggcaaaaccccgtctctactaaaaatacaaaacaaaacaaaaattagccgggcatggtggaaaaccagcccacgctggtagtcccagctactcgggaggctgaggcaggaggactacttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaatgcgctctgccgctttgtggggggaaaaggagtttaggaagaaagggatgggtggggggatgtatttctccctggtctgtccacccaaagctctatgatacgcttccacttctgtgagagtcagaaagtggaaataactcctgctcagcttctaaagagggggaggttgaaaaggcgcagggaggaggagggaggtggaggtagagggtagaggaagaggaggggagaggggccggcaggagagagggaggagggggactgggtgtatcaggggaactgcccctcccggcgctttgatcccctcggtcggtcgctaggagaaaccaacttttctccttgggttaatcaaaaccaaattactcaggaatgtggcaggacaggtctgaacttccaggtccctttgtctttgaggatttaaaatgaaaaaaaataaaattgttaaagcagatggccgtggcctactcaagaggtgaagcgaagagtctgagggaagtcagaccacatctctcaccctccaaaaaaacacacccgcaaacttcctatgccaatttattgtgagagaagttatttttgtagacaacatccaaaaatcagaagaactgcccatttcatccttactgctgcgcaaataaaagaccctcaccccaccctcccatcaactataccttgtcaaagtacaaatacaagagaaccccagatttaagatacacccgtatatcacaacccgactattaaaagcggagtccaaactagctcaagaacatacgttttccaaacacaaagtttgggagtatttttcagtgtaaagttcttccttaggaatactggggtaaggaggtattcaaatatccggttgctattcaaatgcatccatgaaatttcatggttactgtaaaattctgcatctctttaagttctaagaaaagcggtttttagggaatgactcagaggagatatgaaatgtcccactgagtgacataagatcccactgctcatctgtcgtctagaaaaagcgaagaacctgccacccagggctgttctgtttactaggaaagtctgctgggtgtgctggccagcccggcgacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattagggacagtaaaaagtgacacagcccagggcacccaggagcagaaatatgaacagcccttcgtgtgttataaaatgctgctatgcttcactgtaaaacctggctgacccccatgtcccccacccacccaaaaaagataaaataaacaaacagagcaccaccggttaagctatagagccaggattcaaaagataaagtgagaccaacacacagccatgactaccagcttgccataaatcgtaactggccccaggcatacggttatctgggaagctgcacaccaacttttaaaatactcttcaccttatctttaagcccagtcaaacacacacatacatcacccttcttagatctcggccattagtattccatttagactttccaaaacaaggtcatcccagagggtccttcccctctttccagtcacagctgtggactttcatccccttgtccaacaaaagggaccttgtacacaaaattaacctgaagcattagtctgtgtggtgcgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaatatgacggccacaactgcacgcggcttctgagcactggacatggggctggttctgagcgttgagaccagaacatcatggtgaaatcgtgggttgctgaaaatatctgttttaaagttaattccacctgtttctttttactttttatgaatgactactaggaaatgtacaattacatataagcttgtactctctctctctctctctctattggacagcactagagaggtgcaaatgttaccacctcaagtgctagcacattaccatgctctaaaaggaaagactcttcctttttattactattattattattattattattattattgagtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaaggctggcctcgaacccctgggctcaaacctctgggctcaagagatcctcctgcctcagcctcttgagtggctgggactacaggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatggggggagtggccgggaacctgccattgttttagaccaggagaagcaaatgtaacctctatttcaggtgttcttaactggaggcgattttgcctccccaagggacagtgggcaattcctgcagacatttttgattgtcacatcaagggaagaaggtgctactggcatctagtggggagatgccagggatactaaatgtcctacaatgcacaaggtggcccactccccccaaaaacaattatccccaaacatcaacagtgccaacacacaaccaggaagtgaccaggcctgagatccacccaagtatctctttttttatttttttatttttagtagagatggagtttcaccacgttgcccaagctgatctcaaactcctgaggtcaggcaatcctgcctaggcctaccaaagtgctgggattacaggcatgagccaccatgcacaacccaagcaaatttttaatactcagatatccaggagcaggaggggacatccctttgcaaaatggcttctctccagagctcggaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaagagtaggcctctaacagagagtctgaactgggggagtcactggcatgcccagttcaccatgcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctccacaaatcactacaaacaagccaggacaagtcaggcctattagcatacacaagccagccggggaaggcctctctaggtgggtcattgagtaggctgctcacttggagggccgcctgccagcctggggagggggacagaaggggagggctggggtggatgggggacactgtaactatttcagactctttcacttctgaacacggttgcaaagatgtcaaaaggagttggctctatttccaccccatggggaagaagagaattgctggaccttttagtttatttcttccaaggtggtaagaaacgaaaggtagcagaggccatcagtagcaaagaaagaaatgaaaagggcgtggagatggcagccaatatccggagaagcttttcagtatgtgaagtggtatgaagccctgattcctatttcatttacttcccactacaaatgtaaggtatgcattaggcccattttacagacgaaagaagtgaggcccaaagaggttaaattactggtccaaagtcacacagctcaggcctcaccagagggtgtaacactgatggcctcagcagagggtgtaaggcccatagcagaggaaagagcagaggccacctttccaaagagtgggcttttttgattcacctttgcttctcccattcactgttgagtccccatttgaaggggattcacaagcagtgctctggtcctcagccagaccctgccctgttttattctgtaattatttcctaccttcaaacaaacaatgaggaagaccacacctccctccagttacacatctgggagtccgcaccaggatttcctctgtcacccaatttttccactgtctggacaatttttatagtttcaccagcaagggcaaaatatattgacagtcctttcccacaaggtgtaaaagttctctgctttccccaaatatacctctggatttcctatctgttgaaggaaaaaccagcttcgactgcctccgttaaaaaagggtgtgcagggctgaggtgaccctactaccgtcatttctgccattctttacttgaacaacattttttaagtgggcaaaatactatcttatgaaaaacaaaccaacaggggcccaggtaacacacattcatatagtcagttacacagactgaaagtcttcatcaatgcccatctcaattacgttatcaaataacataaggggacactattcaagattccatcagaacagagatggcatttaaaagcagtcgcttgagtagtgacaccaacctcctgccgcacacactgaaatccatgagcctcttctaaagtgtccaaaagttgacctgacactttaacgctgatgcagatactccacaaaaaaaagcggagctgttaaaagggaagcagaaaccattcctccagtcaaggccaaatgtacattaagaaccaaggccttgagccaaagagcattttaggaagcagggccttaaatggtggaagaggcttgcattgcttcttgagtagttaagaacaattgtttaaaaaaagaaaaaagagaagttgggagatggagaagaaaggcacccatgtgttcttcagcaacttccacgggacaaagatgttgggaagggagaagtcatcagaaataggccactcaggagactggaagcatggggagcagctcagttcatgtctacacatatgtggtttttatagactttcaggagtttaaatgcttctgaaaagcgatgtttgcatactgaagggagacagacttccatatttgaacaggcacttatatgactttttcaggggatgcagggctgagatcaactatcagattaagccccttggtctttctgcactcggctaatctgcctcctgcctctccactaaggagattcaaatgagaagacagaggcagtcgcctctgaactagaatcttcctactgaaatgcagagcctatgatagaaatgggcaccggggaccatctatccaaaagccagcctaaccgatacactcagaagaatttttctccagtcacactcctggatggagtcaggaacaaccaagaaacaagcaaaactgttcttttgcctcctccttcctgaaagaaccccatcaagaagcctacacatgacccctccagtgtgtaagccccaatcatgcctaaccaccccaaatcaccccaagtactcagccctactcaataactaacaccctctcccatctacacagaacagcgggtataggcagtcactgactcctgccctagaagcatcgggcgaggggtctcactcccagatcaaaggtttgtggccaagataacttttgggacagtggatgaaatcagcagcagatgaaaactccacagcctttttcagagtccagtggagccagttctcccacttccagtccaagtctccctgcagatgactgaaggtgatccatacattcctaactgctgccccgaaagacccacttacaattaaactccaggtcaccagttaagaaagcctttaggccccttatgtcattagcttcctcccagaaaccaagcagaatagaaagtgagaggcatcccagcaccggcccatcttctcaaggtgtggccttgcaagggagtttcagtggcttcatcccaaaccaccagcagccaggagtaggggtgggagtgcggcagatgttttgcccgcctcactggaagctttagacctgactccagggagggaaaaggatggacaaatctcagaggcagcacatgtgttaataccaaagctcaaagaacacacagcagaaccacctaagacctccaggacacagcaagccagctaaggcccctctggaaaggtacacatcaaaccccccacacagtaatcctcatgttgagactgctgtggtgaccctctgatggacagggagagggggtcacccaaaaggcagatgaagcccaggcattttgctaagaggcccgggctggagttaaaaccaacaaaacagaagtcttgcttcaaaatggggctgaatttgccatctcgcaaactttctatgtctccctccctgtttttatttgagcccttattcttgtaaaagcaagaaactccatgaatgaaggctgaaaggcagaaacgtcaaagaaagaaaaaatcccctttaaatgttaaaagccaaagtactttccttgggcaaataactctctagagacacccccatcactgcctagaccacggccttgtcctcacccacctgtcccctggcccaaagaatgaaaaccagaaacattccagtcgtttccctacttctgaagcttcagctcagtgctgctgtcaatcggcactaagccttgctctgcacctctgtcctcagtttctgtccatatcaaagtcatttaccatattagcccaaagaagccctccaacatctgattgccactttgcacatgttcaaagagatcaatctggcagtcaactttaaatcatagagaaaagccctctgacagttgttgattttgtagtgcttctctttaatctggattttcaaagtggcttgccaatgagccaagatttctgcctgggtctctccctcggggcggtttgacacaaccgtagcttctgtgtgctcctttctcaatctgagtggcctgaggacacaggacactgtgctttggacagaacaggcgccctttatgatttaaactagctcctgccaaggaattcccttgcctagattctattaaaactgggttcccatttcccctgaccatagttttttaactcaggcagaggacggtggttctgagctgtgctgtgatttctaataataaccattaccaccaaattctcataccagagcatttggatacccctatgaggttcactgtaatggaatctgccttcctgttgtgtttttacagtaacgcccccatcctggttaattgcaccagccttaggaaccagagcaagccaacaggcccaaacatcacagaaataggccaggctaacagcaagcaatcattttaataacaaatgaaagcataaaccacagcacatactgtacttcttcaggttactgacaggcatcttcagtgtgcagtacgagtgagggtgagatggagtttatataagtttgttcagaccagaatcattgctgcctacttgtaagtcaaggctaaatccttagagctgagaaacaagtgagttactcttaaaaggtgagtgtttgtttgtttgtttgtttgtttgctttgagatggagtttcggagtttcgctcttgttgcccaggctagaatgcaatggcccaatctcagctcactgcaacctccccctcccagattcaagcgattctcctgcctcggcctcctgagtagctggagttacaggaatgcaccatcacactcggctaattttgtatttttagtagagacggggtttctccatgttgatcaggctggtctcgaactcccaacctcaagtgatctgcctgcctcagcctcccaaagtgctgggattacaggcatgagccaccatgcctggccaaaaggtgagttttataaagacagctcactttcttcccctttaaataattcaagccagttccctacacttttacaaaatgttgcttagtcacttaaatatttactttttaagatgacactgttacaactctgcaataaaaataatttcttaagtaagggtctgctctgagccctgaagcatttccagattcttactgatactttgtaggtggaagaaaaaaagctcctacccctgaaagatacaccaaaaaggaacaactgcacacagtgacaataaggacatgtttcctggatgctagaactaagccacatcaccactagccctagaaatacttttccagcagtctgtaatcacagatttattctaatgaactaaccacttttgggtcaccaaagatgagccaggccggtcctgggagtgtctagcaagcatcatttaaagtcataatgatgaaaactaaatctcgcttattttagctccttgccactgggctgtccaattggcactgagttgacacagcagttaaattcaacctcaaagcagcaagaaggcaggcacttcactgtcctggtgggaagagccaggcaggggcctgtggagggcaccgttttagatgggcctttccaaccctcccttaacattcatttgtgcaaacaaaaaatggaagaaaaggaaccaaaattaagtttcaggtggttggggaagcagcatggatttacattattattattattattattattattattattattattattattgaatagttagcaagtgtttctcaatagttccctgttcatcaacactgttttcaggagaaatggaaaacagtagctctatttcatagaaagtacagccatttcaaaaaaaaaaaaaaaagtgggggggggttgttgagagagggaagtgacccatgtcataaagacagaaggtctccaagtcacttaattccttgtgattctgaaagggctgtttttaaagtctaaaagtgctcgcttctgcatctgctccatgttgttaaataacacttgtgtaattaaataaaagagccaactgtgaccccagcccactctgagaggcactttacatgctttctgaaaactatgctggaaacaccatgaggagaactccttagtcctgtaatttagcaaagggagagagaaaaagtttcttttggccatcatagctacacactctctgaaagggtgcctgcagggtctctgcaaaacagaatgaacacaaatacaggcgtgcaaacatccaggtatgtacctctctgtgaagaccccattcttgaaacccttcaattatttggaaccgtggtctcctgacttccctcacacctcacttttgccttcattgtttttcatgtttgagtagcaagagggattcagaatctcaggctgccagtggctgttctgataacaaggagcagactcatgtttcttgctacggcctttcttgatcaggttaccttggaaggtgtatgttttcctacccaatgcagtccccaccacagcactctcgtgtcctcctccagcccagcctcctggaactcgtgattttcagggtttcccttgaaacctatccagaaaccacagccattaactgaacgtgaagatttgacacctcctgaattcaggaatgagggaactcgaggggccaactctacaaactcgcacctgctgcttgacggcaaggaaacagagtttccccagctagggtgagctttaaattatacactatttatttagtgacttgtctccaaggatctcaaagcatagagagaaataagatgatgtgtaactttctcacaatctaccttcaaggctttgccctggtgcattctgacaagcaggacccagtatgaaggagaggccttccttctgtgcccaggcagagccatctgttctctctggggttttctgtcagtggctttagggagtcttcaaggactgttaaatgacacagagggtggggggagggatgaccctcctggattcacctgctcacggctttcacttaagccagtttaacacaggaggtaccactgtgccacgcaattccctcttagcacacaccatgcgtgagctgcagtctttgccctccaggccttttcctatcataacacaggtgtgtccaaggcagaaaagaacattttccagaaggttcgtttccctccaagcctacaatgcttctttttgttgttattgtttttctgctactgacctaaacataggcattcctcctcctaacaggataaaaatcttgactctctcctttgcatcagctccccaccccgcccctgcccaaggaaataaatgctctgacttttccaagagtgcgaaaaaactaaaattagagggtggacaagatgatctccaaaggtgccctccagctccaaaactctgattctccctttaattactccacaagcgcattcttcacattgtttcgaactgaccagcgacttctccagggctgaaaagggtgcatttttaggcggaggcacccaaacttctaaatgacaccagtaccacaagtattcagaaggcaggaactaatccaaaagcagactcaggaaaggaggagggaggggaggacagagggaagggaaggaaggaggaaggaagagctttactgtgtgcccagcagaatttaggcgctctcaccctaggtaggtggcaactggagtctgggagttcaagtgcatccagcctgcccttcccccacacgccccaagagaatgggaagttcagccaagactcgcagcacctgcccgcggctccaggccggctgcgcggacccggagggaggctgcactcacctggcacaccaagcctccgcgcacctccggagggaggcggcacttgcaggtccgggggccgcgccgccatgcgcaacaacgggaaattccagtggcacccgagccccgagctcacccaccccaggcggcatgctccccacctcccgctggccccaggactcggaggtggctctggtcaggagcagggggcccggagacaggggaggggagctcatggtggcggcagggctggcggtcggcccgtccccggagggaggtccccgggacgcggcggggattcacccacggggcgcggcgctggcgtccgggtccccggcctgcccgccgccgccgcctcctcctctgccgccgcccgcccggaatcgctttatgtaaatgaagcccaactcgcagtttgcagcgcgcaccgcccggggaaggggggcgggcggggcggggggccttcggggatccacattacacagcaacaaagcggaaggttaatttgaaactcacagccccgctgccgctcggctccccgggcaaagcctgacatctacagtcgtgccgggcgcaggccgggttgctcggcggcgaccgcgcccgcccgcccgcagggacccggggacgcacagggacgcgcgggacccgggcgctcagctgcgctcgctccgcttggggcgcgggccttggggcaggccgggggtcccgcgcacccgcctggggccaggaaccctcgccgctcggcctgcgccgccccgggaaccggccccggcgggaacaaagcccaggccctcccggaggcgctgacccctcgctcatcaaaggtcaggggccggcctagaatcgggcgagaagaaagggacgcgccctcggccactaaaaggagcctgaggcctccgaaccggagccatcgctccctgggccccgtccacgtcacagccaggccactcaagcatggggacaggagccaatgtggacaggaatttattggaaacacacacccatcctattaactgctttacagagcacttctgtttttcagttgcagaaacttataaaaacatccccctgctctccgttgagagtttaaggatagtttttgaggccagagaaagagaaaaggagagatcactagaaagataggaagaaaagaagtgggaagaaaaggagatgcagtctaccatgtaagcctccaggctccttagcctcaccttataaagccacatcaccgcagagatagcaaagatcgtgccctttcccagggagttcctaccgccagggtaagatttaaagcggccaccccagttggtcaaagtgattgctgggcgcctttctatctccccaagttcaccttttccagttggtcaaagcgattgctgggcgccttctatctccccaagtccacctttttccattctcatctgaaagccagccccaaagaaatctcaccggaagtcctctgtcctccctgtcagaatcccaccctcagtctgaatttactcccgattctcacagcacagaaaggcacctgcttttaccctttctgaaaaccacccacccaggctggccttacagcctggagagtcttttcctcgggcacaataatgaaccatgcaagtgttagaaatataatcagctcatgaggcgaagagcagtatgtatggaattgtattagcatgaggcacacactgactcgggagaaaaagggatgcttagctggtgaaaaccatcacatccccgtatagaaggctttttgcacaatgtaagttgggttcagattaatgtaagtatctaacctgttgggtacagacagcccctttctacattttagtccagaatagattctggggaaatttatttatttatttatttatttcagctaaggccctgggagaaaagactgcctccagggaatcatgtccgattagggacaaaggagggcacaagcccaattcagtcacacgtgagagcacgggggccgggtggggggagttaagagccaacagggaaggtggaggatgagtttgcaaaccagactatggtcactgcagagctgcttccagaccacctgacttcaggcccaagaacaggtggtgttttcaaaacacactgttatttatattggccatataagttgagaacaccttaaagaaaacaattaataatttaattgaaaaagtgactatgaataagacatgaagatgacgtatgctagcaggaccgcaagcaacgtggcccacaacgcagagatgcctctggcaatctctccggaaaaacgaagattccttacctgggataggtaaggcctgctggataaattaaagacaacaagaaaatgttgatactctcagaaaatctaattttgctgctttatcttcatttttattaacaggggacaacctcgtaatctggtgacatcatgatcctggtaggcccacagacaaataccttcaataaaataaaagctagaaagcccaaagaacaagctattaaagtaacctgggaggatgcagcactgcctgggcagaaggcccggacgggatctgccctaatactgccactgtcccaagaggcagaccctgcaacctgcctcctgcacttgagaggcctgacaagtagaactgagagtgaccctgagttccttttctttatctggcaccagctacacacatgatgaggcctagtcaagcctgcctttgttccaggcaaaaatttaacaggtaatccacaggcaggtgatctatggcctctgtacattatggaaatgagggactacacacaagctgggtgtcacctctactaaaactcattttccttattcataaaaacaatacctcttcagagggaattggcaacttctgcacttacatatgaaatcaggagttcctctgaaatactccttgcaaattctatcctccagctctggaagccctggctcttcggagggcagctgcctgatgttaaacccatggcctacccagcagtgacagcctgacattctcatcgctccatcctgaacactgctgacaaataaacccactctcagaaaaggcaattcttccctcgcagttctccatacccagtctcgtctcatctggaaagcgtaattggcaacagccgaaaggataaatatttaaaaataaatcagggagcgctaaccccttccctactcctccccttacccactctccaagccagaggcctgccccctaacgctgagctggctggtaaattacaatgattctaccgagccaaacctgcttgtctctctctttctctacacatacacacttactaatgctgtatccttccacttttgcaaaggtaaatatgatctctaagatacagtggatgtcagcattctgacttccagcgtaacctgggctctcttttcacagtacagcgggtttagacagatttgtgcacccttccgggttcttctatttttattaaattatacgtatacattgatttttaaaactagtgcttaaataacccggaggctttaacaaagaaaaatccagaagagggcaagaaacaaaaacaaacgttcctgaaataaacaaggaaccatttggagctgaattggcctgagttcaccccatgattttgaggcagttatatttaggggcctggtacccgctgggtggccgagccctcctgggtatggaacagaatgcagaagttcctcagaacagctcacatttgccttcataaccattggaagctggtgtgccaaggcctgcacacagatgttttgattcacatttttctgctgaagcctcaaggcctccatccatccctacagtgctaattccatagattaatttttacccccaaatcgtaggtggaacattatctaatttccttacccaccctccccagctcaggtgctaaatctgtcaatgatatcccacaacaaagatacaaatgagtaaccattttttaaaagctgtgatttcggagagtttttctaaattaattttaagttacaaagccccaagttttaagaaagccaaaatacagaagttgccttaaaacagctttacatgttaggtaaagagctctctctctctttctcgctccttcttttttaaacaaaaatattatttctgaaagggcaaagggaatttgccatgcaagacttttaaacacagggggattcttacatttgtgtttctaaaccttgaaattgagaattttaatgaaaaggcggacagatgcttaaggacagcatcgcaatctgggtccatacattacaggagagagaggcgctttgtttggggccaagtaaaaagaggtgggctcctattttgttcataggccattcccaccgtctgacacatccctttacagtcggtctgatgctaaccactgaattcttggaggggaagcaggttggaaggagaagaaaggaaaagggaaacagaagaggaaaagaaatgggcgatgggatactgcctgtttatacaaattgtagatttaaaaaaaaaaatcccaacacggtatccattccatagtatgtaccaaaagcactttcacacgtgagttaaaacgatccattaaatgctatatcgaaagtacaacaaccagggttggagtttattttttttttttaatgaagaattcattgaggtttgcagttctcccctattaagcttctaaggatggggcacaaggcaggaagatagacaaaagatgacctttttcacgctttcccccaaataattctagaatcctattttcctatcttttcattttagggcatttgggttcaaaaatctgtgctaatctgacttcagagcccccgagctgaaaaattcacatatcctccaagtcagccagtgttttagaatttggatttctattgaggctgttccaatcgccagtgaggcctacggtaaaaacgtgcttcatgctgtttcgtttgtctctctgcagacaaatagaaactgtgaaatttaaagaatggatgaaaaaaagaagtctaaaacaaagaggttaaaaaaataggacaaatgtttttgcttttctgtctccccggagcaattgtgtggggaagtctgcattgacaataaccatgagaaggccatctaaaggcgatgcgtacacaaggggactccttccctgctgcctttggtctgggagaaaaagtaccttagctccgttctccagaaacaaaaggccagggccacggaaggggggagaggtgacaggggctttcacatggagccaagtgtcaatgctggttcatttttcacccgtcttacttggaaagcggctcagggaacttcctaatgactgctttttccctctctccctattatttctaaacctaaaagaacaaaacaataattttttttttaacctaaaacccatcattctattagaggaaagcctttggggcctatgcagtcagattttcctctttcctttcctcatcctgcttttcttttcttttttggaggggggttccaattgtagatcacatggaaataagagacactggacactatagtcatttttagtgacaccagaacggcctttatatctacgaaaaggcaggaaacggggagaaacacacatgcacaaacaacccaacagggatggaaggcggtggtggggaggctgcgggggcaaggccttgaaacactttctttttttcacagcatgaggtccactaatgccagcttcagatttgcaactgaatcaaagtctccgagtcgtcattacaaggtttttcggtgggtgggggcatggagaagtggacaataaggatgtattaaagacacagacaaggtgtggcaggggcaaagtggggggaggtgttacaaagaaaggaagctgagatgaatcactgcgtgccatgaaaataccagggcgagtggatgtcggagtgtttaaccagatttgaagctggaagcatcttccccagcgggcaaaccctaggacgaggcacagccacgcgaccctcagcctttgaacccagacctggcagcttaggagcacactcccccttccccaggcagccacaggctctgagctgaaaggcaaggcgggggtagggataagagggccctgcaaagaagcacaatcaacaactcaaatatgaacggaaatgacgtcagcaaagtgaaggacctgtttactgcagatcaaaacaaaacaaacttccaaaccttttgtgtacacaagaaaactctataaaaagccttcctaaaatgtcaccagggtcgacacatcagcagccccacaagaaaacgcatgacagttaccatggagggaggggggaggaaaggggctgaagggaagatgatctggggggctggggggaggagtgataaaaccagaaggagcccaaaacccagttactactgccccctctgctgatccttaatatttattggtgtttataatctaaaagccatgctccacgtttcacttaatacaaggccagacagtgttgtctaatgaggtagcattacaatcagcttgtaatactgaatttttaatgctgccaaggattctgttacataataatatgaaaaacagaagctgaaagtgggctcgcaggggacaggacattcgaggttccaggcaggcgagcgccaccagcccggttcccctcccccacacccgcccccctactttctgacgtgcaatcaaccctccatcccgatacaggaggtcggtatggaaaccaggaggattttttttttttttttttttttttttaggaaatccacacttttcattattattgttattatactctcatccgaagtttatagctcaagagtttgaattctagcttttctggggttaaaggtctaaaatgaaaattaatttttttggaagaggtggcgaagagacaatacaggggaagagaggggtagcttattttaagcaaaccaagaaatttgggagaaaaatcacagagggagaaagaacttggtgggggagggaatagatgtctgccgaccatattcacagctgccgcactcagtttacattggtgtaatttaaaggcatatatatagccgccgttgctcctctctgtaataccccaagactgtaaatctataaccactgcaatgatttagtgattaaaaacatgataacatattgtgtaactgcaaaccacagaacccctgccaactctctctctctaagataaaggggaaaaaaatacagaaaatgtgttgcttgcagccatcttcctaaacccaaaagattttaataaaagaacctatacagcagacgaattggaaaggggtgagtgaattctgtgtgaagccagcaaagggagagaaaaaaaaaaaaggcagctttatgtgggattcttttccttgtactaacaaattacgacctaaacatgccttttcttttctctctctttttttttttaatagtttgttgtaactggaataactggtcttgtgcactgtcttgcatattcaaagctgctttgtaaccggatctagagacccaaccttatttgcctgaactcaatagggtttttttctccccctcctcccgggttttgttttggattcggtattgtgggttttctgttgttgctgggagcctatgtctatgcaggcataggctctggtgcctttaaaccacagaccaaacacctgaaagggggaggcacaatttgtacaatggcaggaggagcctaaaatatacaccaaaaaataaaatcaaagcagctgtaggggttttggcctctgagcagctgacctgaccccgttctgtatattcttttatttccccattgcaggattcctgcaccttgggtcagattcaaactcaatgtgaccctgaggagaaggcagtcacagagtcctgaaaagctgctccatatttaataggggtgggggaagtaagtgcatatgcatccagactcccccagtgaagacacccacacggtgcagacgtacgcgcgcgcgcgcgcgcgcgcacacacacacacacacacacacatacacacacacacacgtcaggactgccaggccatgggaccagctccaccccagttttcttggcccacaccactgagagcctgaactctctttgcgggccccccaaatcctcatacctacaactctacacacacacacacacacacacacacgcagagaacaccactcctccagagactttgtatgtttaaaaagtccacagatctgaatcgcctcctctctggaccggagcagggcagtttattcagagaaatcaataggaaagagcatttgcaaatatttatataagccctgtgcgtttcagcattaagtaattaaaaactaaaacccgaggagggggaagggagacacacagacagaggaaggctgctggcctagagtaggttttcctgcccacacctcatcttcccaaaccgcagtcttttcaaaactgactccgtgtacactttttacgaaatcctcttcgtacaccatttgctagactatttcaaaatcatctccaaatatggattcacctaccaccaagctttcaagactgactgtgtctgtattctatctctcttctcatacacacacagcaactcatacttttgacactgcgtcaatctctagtatattctcttttattttcctatctctaatatacctgcactagttaaaaaaaaaacaacaaacctaacattgtaagataagaagagggccccccaagtgcccattcaagaagcaaactcccaacccctaggtctcctgaataccccccactcccctcaacccacaggatgtctacactttgggggttcagctcctgaaacccccacatgtaaacagatttggaaaaaaaaacaacttcagcaaaatggagttttagaatgagctactatggagtggacttccctatattgttccggagggcagggcagtaaattctggttgttctccctctaaatcctctctaagaagccaagcaaggcgctggagcacccacgctgcagatattgtagaaatttacagtaaatgtaggtacacgattgcagcacgctgccctattgattatgcagattgtgatcaatcttctcccctcgcccactgcccaagcctctttcggaggacctccaaataagttggtctgcaactagctattctcccaaagtagggaggaaaaaaagtaattttttaaaaaacataataaatcctcaattgtccccactgaaagggctcgagtcttttttaaattccaaagtgaatttatgttctgtaatttgcattacagccaagcgatcaccgtctgtcatattcttcaaaggtacttaacaaactgccttttaaaagtcactagaactggaggccagaaaaaggcaatcagcatgctccgtccatacagtgcttagatcaagtttcaataattgagaccaataaaaattgtcatatttaccctacttgaaagcaacaagggggaaaagttaagactgggtgccttttgaaagcgcttgtaatcaaagaatttgccacagtccaaagaatagcacaacattgaacaaaagtcagattctgagcaacagcttcactcgcaaagtgatatatacatattttaattcaatagttatacaagaaccctccgagtactgagtccatacacaacttaattatatacactgcatgaaatacacttagatctactctccaatagatatgcaaaaagacggacattaaaatgcataatgtaaaattcaggaacacggtttttgcatcgagtggagccgggcgaggggtgagagtggggaacccaacgtaaacaatcccagattcgcgagagcaaaaaaaaaaaaaaagaagaagaagaagaaagaaaagaaaaagaaaaaaggcatcctcggatgtctctgagctcagctggcggaagaaggccggccgggcgaggtctggccctggccagcggcgcagccccgagcccccgggagcccctagtgtccagggcagagtcccctctgggcgctcgcggcgctgccagtggggcagggcggagagcgcacaggtagaggatcgcgcggccgcctcgccccctccgggaccccgtggctccgaacgggctcccgcgtcgccggcaagtcgagccccagcgcggaaggcgctcgcccggccagcggtggcggccgcggcagcagcagtggctgcgaccgcggcgactgctccgggccgggtgcgcgccccgcgcggctgctcagcccggggccccggcgcctctcggggtggggcaaagttgggggccgggagcggcgggggcgggggcactcggcaccgcggacccccccatactccccccaccgccggccgccgcctttgtctccgagctggtaccccggccgccctcccgccctcggcccgcgccccggccggccctgcctggcggcgcctccaaactcgccgcgcgggcctcgccccgggcgcctccaccctcccgggggtcgccggcggccggcggcggcggcgcggggccggggaggagggggcggcccgggctcggcggcggcggcggcggcagcggcgggaggaggaggaagaagaagagaaagagaaagtttggcgtagggggaaggcgagcgggacgcagcgagcgagcagggcgcgggcgcggggagcgcgggcggcggcggccgggcgcgagagccgggagggggcaggacgagccccatgcaaagcagcccgggcgccccgaggagccccgcgtccgggcggtggcggcgggaggaggaggaggagcaggcggcggcggcggcgggaaaaaaaaaagagggaaaagttgccacttacgcggttgcttctccggcggcggcggctgcagcggcgctgctggcgacggcggcggcggcgggagctggcggcgcttttaatcccgaaaagaggcgctcgggccgcggagcccatcaaggcagcagcggcggctggcgggggtcggcggcggcggaggacgcgctgctggcggcggcggcggcggcggcggcggcggcggagctggagcgcgctcggcggagcccggggcgggaggcggccgcagccggggagccggagccgccgccgccgctgccgccgagcagcatggttggcggggagtttacagcccccggagcgggcaggggccacggaagagaagcggcggcggcggcggcagcggctctaggctgtaattgggatgcaaagcaggcggcggcggcggctgcggccgggaggaggaggaggaggaggcggcggcggtggcggctgcagcggtcggaggggacgcgctggaagtgggagctgatgagtgaaaagaaaaaaaagtctttggatctttattctgctaattagtttcctgcaaaaaatggctgtgattaattcagtgcgcatgtgcttcattacccaggcacgacgggaagggctaattagccaccttctggatcaataagattcagcaaaaaagaaaagggggaggtggagggaggcagaggggaggaagggaggaaaaaaaaaaaaaaacaggggaaagtgatgagcagggcaaggagagcaggaagagaggatgggagaagagcctagaagagggagagaggctccaaaagtttatgcatgtattaaaaacacacacacacacacacacgacacacacacgagcgcgcgcacacacacacacacacacacacacgcacacacacaccgagaagtggaatgcataggagcaacaataggaacctggctaagaatctttttaagattttttttttcctttcttcttcccccccttctcttttctttcttattattttcccctttctctctctctctctctctctctctctctctctctctctaagcaaacgcagcaatgtttaaattaactaggaaaagagcatctccaaagaatgggggcattagtggagggggacagcttagagtaaaggtttaagtgaaagagcagagacttcgaatagagaccactttaaattgcaaatctgagattttttaactgaaggaaaattacctccccccaaatcagaggacgaatgaagaaaatatggagaaaactttaacacataccatagactagacaaaaaatatatgttaattttgtgttctgaaataagacgcaatcggtcttctctggttctttagaaggagagaggaagagaggaggggtgattagaagaaataaaagggagaaagtgaatcagaactgaaaggggataacttcaggaaagacaagaaaaggaaaagttgcacttggaaacaagtccaactttctacctttctggacttaagagaaaagtaaaatcaattttctcgtgtgaaacctggaaagcagatgttttcaaaacacaggaagctattttgccatcaaaagcagggatgtaataaaggcagtgaaaaataatttcagactgaattcataagagagaaagccaatatatttaaatatagaggaaaggcctagggtgtagaaaggggaaattacataccccttccctaatgccaaaaaaaaaaaaaaaaaaagccttacagctacctccaagagtttggagcacagtcacgaagccaaagggcttgaaatgagaggatggatttcagataaagactaggagcggtacatcccactagagcccaaaggagatccctggaatcaaagacagcagcgagggaccctactactgtaccgattcccagtacatcaaagccatcacttaggctggtgcacggtacctccaaaaagcaagcaaacaaacgcaggaagaacaagagtcagtgtctgtctgtctctctctctctctctcccccctcttctctgtctcttcccccccctttcaaatcctagcctcagcgtcactgctactgcaatagattttttaaaaatgacaagttgtatttatgtaagttctaaatatgaactaataccattgaaattacaatgtctggaataaaataaaatgcaatcagcactttaagtaatctgcaaatgtaaaaacaacatttatgtttttgaaggcattattagtaaaccctgtaacaccagatagcttgctaaaacttatttttcttgggaaaaaatgttgccctagcctaccagattatttattttagaaggaatttgggaattaatcaggaaatctgtttgattagaaagtaattcttcattttgagagattttccaatgctcttaagaacatgcagcttcttagtcaagactagagagaaaaaaaccggtttaggattttgcagggttacctcatctaatccttctgaattcactctgggaataatgctattttatttacggggggcgggggaagaaaatacatttagaaaaatcaggggtttcctctctgtgagccaaatctgggttgccattcaaactttttctggctgcttttccatgcaggacagctgatcaataaagccaagtccagcctggcttgctacaggtttcaccagtcagtgcttgcaaaacctttgtcattttctaaaaataaaaaagctaaaagttattgtagaagaaggggcttttttttgtcccctgcacaatgtgtcttttgtgaggttaatgccattctgggctctcgatagccctggacaatggggaactctctaggagcctgcaaagattctagcttttttctttcttgcctttttttttttttttttttaagggaaggatgaaacattcctacagtccaaacacaacctctactgtgattaaataaatatttatctttattgtagccattgtatatttttaccttcagtttgtccggtttctgattattattttaaatttttcaatggcaacagttaatcttttttttttccctttcagtccaaagggcaggtcagtgtaaaatgtagctgactgaaggaagactggtaaattctgaatttttccataatacatcaggtaaggaaaattgttcagaccctcaggaatatattcacttcctttttatctgtcttcacgaatcttcataaagctgtttatttttttaaagatgtggtagaattaaattcctctttgtagatcttgaaaaatcacttaaatactatgtatttattttcttttaaaatgtaaatagtactagaagtgaacttgcagcttgtttcttatataaaacggtgcggaggaagtcagtatttcctttagtataagctatttggaggaaattctggatataaatgtatttcatgttacaatataggaaaatgtcagcttaatctggtaaatacttatgctaattttactgagtgaattcgttataaggaggagaggtaccaagcttgtatgattgaataatgcttagacgataatccagcatctatatggattattttacgtacaaaatgagaaaaaaaaaaggaaacaagaaattcagaatctaaatctttcatttagctggcaagagggcagaaaattttagaccaacctgtttttaagacatttacattaggagggaaagtggaatgtaggctaaatattgcattgctgtgtacatttctctagctctcactcaaatggatatagatataaaaacacaaaaatatatgcataaaggggtacataaatatacatttgaatgacttcagatgtctttgcatttgtgtgagtatgtgaatatatctgtgcacacagatatacaaggtgtacataaattcaggtactgggcagagctgtgtgagtgctcgctcactgggggcttgtgtttccagatctgtttgaagccacttctttgcaaatataacataaaaaggttgatttaatgatgaagatgtgaatggtgaatttgagtaagaatctgcttccctgcaattatcagaatatggggttgcaatgtgagcagctattatttggtccaaaggctaaagaggcaatgggccatcttaaggggcaaggaggatgaaggggtcttaggagatctcacttggaaaaagcctagctctgggccctgggttttcttctgcagggagattggggacacagaagcaaaaaaaaaaaaggaagaaaaaagaaaaccccgtgtggaggcaggagaggttgaaaggacgcctctccgtacaactccagagctagatctaaggaaggggttggagggtgaagaatgtgcgagtcccttttcgaatgtgtattgttattctaagtctattgtatgtacgtgttgcagtcctttcatttgccacaacatatggattccataaatgcagacatgccgaagtgcatctgtctgggtagttaacatgatctaaacatccctcttcgttccgctaactccggctcttcttcgggctcctcggcagcgctccgggccagccggcccgtgccccaggcttgcagcgcccggcagcctcgtccttttgtggtctctgcacgggatccaaggtgccgcgcggaggaggcgggctgctcgcagtgccggggtcagaggcgccgccaccggcggcctctgcgcgcgcggggaggaaagggttaagctgcccgagcccggggaaggggctgctctcatcctggagcgaggtgcagccaccggcagctgtgatttaggggtcaagtccgagatcacctttctcctgcctctggaaatggcagaagatgagatagggagggagaaactagagagtggcagccaggcgcagcacgtgggctccatccatccgacacccccatcgccccggtccactccctgacccccagacaaatcggacagttcccttttctggtagagatgcggggtgcgcttcttctgagcgtccggaatcgctccatccaaggctctgccctaaggttaagccactgtgccctgagcctcaaccaccagatctcaaaagtttgctctcaatgcgccagacagtgagtagctgagtctgagtaaaaatcaccccccctccccgtttacgaaaaccaggggtccccctggcaggactaggccgtttgaatgttggtgctagaccctcagactcctgtcacagtccccacagtcgtgaggggatgtacacagtggtgcccactacatgcagcttcttgctttgtgcctgtattctttctcaggatcttgctttcccccaactcaggcggactggggaatactttggtcaaaataaatttttacacctgaaaggtaaccaaaaaccaaattcagatgtgtttctagggttttttcactggaaaagagcagagggtctgaagtccccttttgttatggttcagtgtccggcccgccaggttgagggtccccgcgcccaggtgacgttctgggggctgtagggatgcgcaccgtgcccacaaaaggcgctttaattgagaacgagcttcccaaatccaactccacgaggatggcatttaggacgacagctctttcggaaagttactccaagaaaaaggagttttttggtgggaaaagaaaactggctcgaaatgacagagagaaaagggaactagatccctggggggcaggaggcaggtggggggtgcggtgagaagataaggagatgagccgggaagtacacggacagggagtgtggggcgcggccagggaggttccgcgacgccctcccctgactctcactccagctaccagggtgagggtgaatcaccccgattttagcttctgcttccagggccaagagcagaccagctggtctagaaggcagctgaggtctgtcttctgagccctgccgcccctaaccctgccagagcctccaaaccgcggaaatcaaaccaaattggccgctcaaatctagagaggtttcatccctggggcaagggggagggaacaagccttttttttttttcttttgaactcccgattcaaaagagaccacaacctactcttgagtgtcatctccagtacatggattgtgggtatgtttcattctttcttttttcctgtttctcagaagtaaaacctttaaagaatgagccccaaacttggagcgcccggatccttgaaagagttccaaatgataaagcctgcccttcattttgaatacatggcgcattgtgaaaatgcagggcaattagtcagttccagggtttgagtcagattcccagtttcctcagcttctttgcaatggaaatctgaaatccaaccttggggcaggaggcgcggagccggtggctctcccgggttccacaccgcctgcaccgctggctagcgcctgacttcccttttggtgacctggtaggtactagaagtttgcaccacatgtaaagcctggggcgagtgaagaagagagagaactaacttcatcacagcgcaacaaagtgaacaacttgagggcaagagaccctcggtcgggctgtgttcgctttagggatttccaagggcataacttgggggaatggtagagacttcttgcttgccagccggagccaggaaaaaaggaaaccctgcgatgggcgggcggcgggcttgggagcagggctgtgagtgggcaactgagacctggctcccatctgcacatagccctcctgggccagcgccgggagacggtgcccacggtggcacgtgcattgttgacacgcagacacgcaggcgtgcgataacggagggatgcgcggctgaacaatccccccaccccaccccatgcttgcatttcttgcaggcatggcttatttaatggccagggaattgagtgcctcttacccaccacccccatcccttttattttttgctgagaaatgtaaaaaggaacctatgccgtgtacatattctgaataaacgtgagggtttttttttttcttgaggaatacctagcgccataattttgtgatttaagggggcgagggaaatctttgaaatgaaggaaatcagtgggggacgaactagcttttcctggtgtgtgtgtgtgtgtgtgtgtgtgtgtgtgtgtgtgtgtgcgtgtgtgtgtctccccaaagccagtaatgggatttaaaatgagagattcccagtcctcgtcctccctcccattccattttgctctcttcgccccagaaaacatctgcgataaccggctgcacgtctaaagggacggtttaaagagaaacagggtttggggagcgcatcaactttctctttttcaaataaagttgaaaaaaaattccaaagacaatttaagcaacaaacgacatcgaacagatatttttccaaggcaaaaaatttccgattcgttggtttcccattctcagaaatagagaaaaatgcgaatccgatcttcccgtgcgctcatgacacgaaatttggagcccgtacttggttaaggctggtgagtgcagggcagggcgtggccccacggccggcaggagtccggcgcacactgggcctggagcgcactgactggggctctggctagccgggctacccgtggggtggcctagggcccagcctgtgtcaaggctgcgggcagggcactggtcccctgtggactcggggcgcgccctctcagccgcctccctgtttaattccagagctcagcgggctgcagggacattcgacgccagtttcctcaggcccgggcgtgagacgcgcccttctcgtgtctgctcttccgtccctctgcgctggatgttgtatagcgcaggccccttccctccccgcctctcgttcccaaaaccttatcattgagaattcgacagttgccccgagatgctgatcccagttcacggagccagcgtgcgcgtccctaatgcccggcacacccatctccatttcgggacccttttttttcctgcgggctctggactcccgggaggaagcctcgggccctccggctccccggagacaccggctgaggcgcttaggccagtgcagagtcgccgcactgggacccaggcgcccctcacaggtgcacgtagggcatggcccaacggcccctcggatgggcggggaaacaggcccgggcggagcaattcgatcaccccattatgcccctgcggatgcccagaaaagccacgaggcccgggggaccgccccagcagtggtctggaaaggagagggcgcggcgaggggcgcacctcgcgcccagggcccacgccgcccaggccccgtgcctgcctccccgtcaccctaactccgcacccgggactgctggtggttcccttctctttccgccgttctcgccgggctgcctagtctctttagggccacagatgcgccctcctccccccagccccgcgggatacggaggtgagagcactgagatggggaccctgaacccaactgcaggaggacgctggacccctatgtccccaggagccccttccagccaaggcctggggagggaaggcgcctctgcacccctcagccccaggtgcaagagctgggagtggagaacccccggggccctgctcgcctccaaggcagaccagaaaccgggcccgccaaggaggcgggagtgggtgtgtggagttagcgaagggccgtctggaggggtgcctgtgcctgcgtgtttggtgctgcacgtctccctccctctcattctgtctgggaagaaaaaagaaagcgggcagatttgagccgacccctctttccgcagcctgggaacgctgcagcaggaagaattgctcataacgacacttaagccccgacagttgaatgctaaaggttaaacttacagtcttcagggaagggcttcctgccaactggaacagtggtgcgcgctgccacgggcgctcctccaccccagcctggcccctccaggtacagttcacatcacggctcttggcatttgtgaacttcagcgaaggagcccctgggtgctggcttgtccctgcccctcatcttcagggaacctctccttcctggtctcccccattattttgcctgtggctggttgagacctcagtttgtccctgggatcctgccctgtgggtcccaactagttcctgctgtgcagttggaatggacccacctttgcaacaaagatgcacggttcacacaggtggacactttggagaaactgcattcatcccttgtccctttgcacagagcactcagtggcccctgcagcttggcacagataaaaccaaggctaatacactgaatttagtgcccagccttggaggggtctgcagagagacgctggctgtaaggaggcaggcgggggattgtcaggtggaaagcttcccccaaaggaatagccaagggagtctctattccacggaccaagggcccctcccccaacccaccaccaaatgatggtaaggttcaatttagcacccctaaaaagtatattccagtaggagatagatggtaaagagaatgcagttcagctctcaggagcaagggaaggtggctcttttcctacctccctagagagcccacatttgctgagcacctaccttgccttagctccctgccaggcactttccaaataattgcattcagttctcccagcaaccctgggaaactggtattattagtcccatcttatagatgaggaataccagattcagagaggttaagtcactcacttaaggtcacacagctattaagtggctcagcttgaatttgaacctgggcctgtcaggctttaaagctatttctattacaccagttgcctctcatcaaggtcagtagaatcaggggacccaagggatgagaaaagatagatgtgtagggcagatgggctgaggcgcaggaaataaaaatattcccggaagggtgctctggttttgtatggattcagggctagattcaagactaagagacaagtcactgatgggcatggtcccccatgttattcactaaagggaaaaaggccaaaagggacaatgcaatagagaaatatcaacaaaatcctaggattacagggttggaacccatgtaacaattgcctggtgtgccccttggttttccagcctcggctggccatactagggaagttcataccaggcctttttgtttttctttgtaaattttctgactgtgtctgaagctcagacaagttccttacttctgtgagtcagcagggctaacaggaagggatgatcagatgaccaactgctcatgaaaaaatatgaggaaatccagtagacagggaataagagcaggcagagacagacatccaaaggcaggccccttgggaactcctggtcacttgagtgctccacttgcaggccctaaggtagggaaggctgtgggtggggcagctccacagctcccttgaaacaaagatgatgcctgctttgccaatattgaggtttggccacctgatggtcgtccaccaactctggcctccatgcgcactgcgggtactgaccacccctttgggcgcaactgcacaagggggaagggtggtcagtccagtggtatgggctgatcactcctcgccgtgctcggctgggttgactctgactgatgctgcccaagtatgagtgtgtgtaactgggcaggactggccaggcccacacggagaggttgctgaaagccttgttaaggaagtacttctgactaggcaatccaattacataatgctgcaaaaataactctgggctgggagtcttgagagtgacgtattttgttaacagagaggggtatcaaatatctgtcttttaacccgagggctgaaagtacacttgtgcatactgactggcctctcaccctctcccccaataagggatgttaagcgggtggcaggggggaagcaaaagaagaagcaatgatgcacacttgttttttcccctcctttttcccaggtgcaactaaagccaactgttcagtttagctatattctgccagctcacgtgtccgtctacagaatcgtgcacacccaaattagccatgcagtgctataaactgatcagggaagattaagcaaaagaaatgagggagagaataagaaatgagagaaaaacagaatgaaaggtggttttgttttattttttggtgggtagagaaggggaaggggtgaattgtctcattatattcatgaagactagactaggactcctagcttcccactaaggtgaccaactggtcccagtttacctaagactgtcccacatttaaaactgcatcttaggaacccactcatttctgaaaaactgagttggtcactccacttcccacgggctttggccaaatttccacccggtcagaaaataactggtcataatggtatatcctgtcaatccaaaattgttcgaagagtgatctaaatgagatatttcatcatggacgcaaaagccttatttccaggcatttgaagaaagatccatacacttcttcctcccactaccattttggattctagagctttccaggtggaaaaattacctgcttcattcagtttgctttcagataaagtttccagaggtccctttcccattttaaagtgccccgaactcctgccatgttttgcttgagaatcctttcataccatttttaaagaacactgcttgaaagtcattgtaccttttttcaacttcttttctgttgtggggtctccattccttcctggggcaccagggtcacacactgaactgtatcaaactcttttaatgtattctcattgaatctgttagcattttctgtttcctaatgttgataattattgcatctgatcctttcactctaaactgcggccgtgcaattcatccttaatctagatccatctgagccccttccaaagaagacacaaagataagctatccctggcccaagacactcatagcatctgagcttagattcacatttgtccccacctctattatttttttttaatcaaaatgtttccaaaccccttgagctaattataaaagcgaatagcttttcctctccgaatcatattccttgacttgtaagaatgcaattccactctgagaccaccttgtcgcagacgtgaaaacctgcttgccgaggacgcagcagagaggaaagggtgaagcgggattcgtctcccgccctccctcggcaggcactgcctttatggagtctatttccagtctgtttacctggcaaggaccacgtgaccaatccagaaggaaatgctgacatcattgtctctctctctctctctctcgcacatgtgagcctccctccctccccaggccgcctgcattccggtatccatcctctctgcctctctccagcgcccggtcccctcccccaccactcacgccttccaccacttatttctctgtctttctcatgtcacactttcctttgttttcttttccccttgcgggctggttcctagaccgtcttgcgcgcgcgcgcgcgcgcgcgcgcacacacacacacacacacacacacacacacacatctgggtgcccttttctttctccctcccctaccccgccccccaaccctcccccccgccccccgcttttcagttttttcagatctgtggccattgagccctcactcttttaaaaacacctttcctctttctctctagatttgagatttctaaattaaaaaaaaaaaaaaaagtctggaggcctaaaaagtcttctgggccaggggtagggggaggagggccaggcaaggctgcggagtccagccattcaatttcctgctccactgagcttcgagatttcggtgttgggggtttggtcaaacatgctttctttctttatttatgtacagcttctcttcttctagtctccattccacgttttcccaccctgctgctgaccaggctcccctgccttccccactgccagaccacaggtcccagcagctcctggccttgagcggagggagggagggagggagcacgtgcaactcgctcctggtcttttctctgctgctgctgctgctgctgccgccgccgccgccgccgccgatactgctgctcattctatcaggggctggggaggctgctcagcatcctcccagcctgagacccggggagctgggaaagccaggatgcagagaggaggggaggagtggcagtccatgcaggtgcctcctgcctgttcaaaggcctatttataggaagaaccagcaggcagggctctggggtttggctgctcctgggcagctttcttggtgcacgtgggcacagagccagagcatgcagtttagaggaaatgtttaataaagacatgggagcctcaaagtgtttatttattctcacagaaaggtggagatagggtgtgcctggaaactgctttgaaagcggacagcaaggtagtgaggccacagggtgacaccactgggaatcaaagggaacagctgtctcaggccaaggggcacaaggcagacactgatgggccccattgcttccacctcccaccctaggctgttctgagtgggatgataccccttttagcttggaagtgggacatggaagaagatatgaagggtcacatgagagtgagacaattaagtagtcattacttaggggtaaattcataatccccagcactcagaaaggtgggattctacctggagggcatgagtacttcgatgggtatgttcaccactgggttggatagaaaatcagaaatgtaggccaggtggggtggctcacgcctttaatcccaacactttgggaggaaggtggatcactggaggtcaggagttcaagaccagcctggccaacacagtgaaacgccattgctactaaaaatgcaaaatttagccaggcgtggtgggggcgcctgtaatcccagctactcaggaggctgaggcaggagactcgcttgaacccagggggtggaagttgcagtgagccgagatcgtgccattgcacttcagcctgagcaacaagagtgaaactccgtctcaaaaaaaaaaaaaaaaaaggaaaatcaaaaatataggatcctattggaagaccctactaagacctagaggtgggactctgaatgttaatatagtacctgccttcagtgtttgggttcattcctatttctttgtttttagagacagaatcttgctttgtcacccaggctggagtgcagtggcatgatcataactcattgcagcctccaacacctgggctgaagcagtcctcccacttcagcctcctgagtagctgggactacaggcacatgccaccatgccaggctaatttgttttacaaattttttgtagagacagggtcttgctatgttgcccaggctggtctcgaactcctggcttcaagtatcctcccacctctgtcttccaaagtgctgggattaccggcatgagccactgtgcccagcgcattcctatttctttctttctttctttttctatttttttttttatttgagacggagtctcactctgtgcccagactggagtgcattggcacaatctcggctcactgcaacctccatttcccgggtttaagcgattctcctgccttagcctctcaagtagctgggattacaggcatgcaccacaatgcccggctaattttttctattttagtagagacgaggtttcactgtgttgcccaggctggtctcaaactcctgagctctggcaatctgcttgcctcggcctcccaaagtgctaggattacaggcgtgagctaccgtgcccagcctcctattacttaagacacatttctagtactatgcccattgaaatggccctggcagccagtcagaagagaatccagttattatgaggctaccttctagagacctgttccttcagcaaagtataaagacagcagggaggggtgtggtggaagaggtcggtcatagatatgtctctccaggatcaacaggatctaaatcctcttcagatatgctggaaatctagaacttcctacaggctttaaacattttgtacaagttctaattttaaacttctaaatgtcataggccaaggacttgctggattttgtttgttttgttttttgagacagagtatcactcttttgcccaggttggagtgcaggggcacgatctcagctcactgcaacctccacctcctgggttcaagtgattctcctgcctcagcttcccaagcagctgggattataggcacctgccaccatgcccagctaatttttgtatttttagtaaagacagggtttcaccatgttggccaggcttgtctcaaactcccaacctcaactgatccaccagcctcggcctcccaaagtgctgggattacaggcatgagccaccaagcccggcctggacttgctgttttgagacatcgttaggtagataactccgttggtcaatgaaattattgttgtggcttttgattccaaataaaactagtgctggaaagtctcaatgtcattctcatcatctcaatatctcatcatttatggagccactgctaaattatgagtacggaagggtaaggtgaagcacaggttcccgactcccagctgtgggtttgagatgcctctgtcagtgaatgtgtgctcttcacttcttatcagtttttgtcaaactaaactccaagtggtggaaagatataagagagggtagagagaatcatacaaagcaaccaacccagtaggattatatgacctttattgtggcatctttcaactttggaggtatctggagaataatacgaaggaggttctttctccatctttgagtctagctgaaggctcaggctcacttcctcacgcggaccctgtcccaggcgcaatgttggaggtgacctcacccagctcctcatattcagctctctgagtgggtttcctgcatttgtgtaaaactgtacggaaaccaaaataatagcaacaagatccatttgtttcactacagaatacctgtgatgatgtggaaatgcatatgcattcataagtagatttgtattcatgttacggatgacccgcttgcttccccaaggataggcaccatatggagtgttcactgtacacatctccataaacgcccaccatgctaattggtactcagtgctgtacccatggggaagagaggataatgagaatgataatgacaatgatgacgacaatgatgacgacaatgatgacgacactaaactgcagatgccgattccaagatgaagatagttctgggcatacagacatgcttaaccaacgaggaaggagggaagggagggagggagggaggatcagatcgcattgaaacactcagtgtaagtcctaaaccaaattccttccttccttccttttttctttttcttttcttttccttttcttttttatttgagacagggtcaggttctgtcacctaggctggagtgcagtggcacaatctcagttcactacaacttctgcctctgggctcaagtgatcctcctaagtagctaattagcctcccaagtagctgagactataggtgcatgccaccacactcagctaatttttgtttttttttgtagagacggggttttgccatgtttcccaggctggttttgaactcctgagctcaagcagtccatcagccttggtctcccaaagtgctgggattacacgtgtgagctagtgcactcggcctttttgtttgcttgttttaaagcataattactctattattacctactaaaaggaagataggccaggtgtggtggctcatgcctgtaatcacagtgcttagagaggctgaggcagaaggatcacttaagcccaggaatttgaggctgcagtgagccatgatcacaccactgcattacagcctgagcaacaacaagagaatgatccccaacttgaaagagaggaagggagggagggagggagaggggacataatatctactgctgagcctgtgggctgggctagaatggcgtaacaataaaacaatcagttttcattgttggtatgtttttaaaaatatgatttagtacctaatacttctctctctcatggcaaatcagtgaggcagtgttggcagctcaggacagactcaccttacacgcaaagcctaaatgtcagagacatgatcttgcagtgatatacaatataaataaattaaaaatatatagaaaagtgaatacatacaagaaagagctacctagaagaatcaaagactttttttttttttgagatggagtctcgctctgtggcccaggctggagttcagtggtgcaatttcagctcactgcaacctccgcctcctgggttcaagggattctcttgcctcagcctcccgagtaactgggactacaggtgcatgccactatgcctggctaatttttgtatttttggtggagacagggtttcactgttggccaggttggtctcgaactcctgacctcgtgatgcgcctgcctcagcctcccaaagtgctgggattataggtgtgagccaccgcacccggccagcttttcatcataaaaatgaaacaaaatttagagaacaggaagattaccaaaggcttgggttccagtgttagctctgccactaacagctggatggcccccaacaaatcacttaatcctcactgtgtaacttctccttgtaaaatggagataacagtgcacaccccacagggttgtttcaggattaaatgagactgcaggtataaagtgtctagcacaatccctggcacatggaggggggtcaatccatggcagaaatgattaacaatattctgatatttcttacctgtcagcattgcagggttgcagcgtgaagatcaagtgattgtaaaagtattgcatgaactagaggaactgaaacaaatctaagatgttctttttaggtgttactgggctctaagttaaatctgttagtactgggaagtggagcaatgagataaagatacgttatcaaggacaaactccctatacacagatacctgatatacctcgttccagccataaagttgctgaaatacgaggaatgcaagtgcctagcagacttcctcagggggatgttgtgaagattaatagtttagaatgatgtcacagttattaaggtgcttggattccctcgagcagaggggatatgtaaatccagggactcatcataaaagtaatatcatcactgtttctcacagccgactgtttcctaagctgggatagaatttccagaagtatctttctcttttagaattacagagtatgacagatttatttccacacatctcacttgctttcagagttattgtttcctcttattccccccacctctttggtgacagagaagcctgagaaccgatcctgtcaggaatttcttggggaattttcagaagcatgtgaacacacagtatgtgaatggctgtgcgcagcggcattaactttattttataaaatatgtgtgtgtgtatatatatatgtatacgcacacacacacacacacgactgatcttccaaccatatctgaataatcaaaaccatgaatgacaaacatgtcagatacattcatcagaactcagaggatcttctaggggaattcactagcatgtcttcctcttaaaataggtcaggtaactattcccctcctttgggactctcaaaaaggatgcgctaataaatctaggccccaggataggagctcagttgccctctagacgtctaatgccaatccccaaattttctgaatttattgaccaacatgttggatggagcaggttcaagcatcttgctaaataaaatatagattatattgatcatttcccctcaatctactaaaatcttgttactctttcacagaaggaaataaatcagtttgacaggacttgttctgtcaagtgatataagttcccaacactgcattcactacagattattctagaaataaattggtaatctttttttttttccaggtgaagttccagattaggacactgcgcacttccctgtttcttttttaaaaatagaggcattagtcctgctttctttcagtctttccacgttgttaaaaatgaagtgactctcccgtgattttagccaataacaacagcttcccttataaacaactttatcctgcaaaaaatctgcttagaaaaaaaaaaaggcatatctactagtgtttaagaaacgtttaagagttcatcctgcaaaaacaatgaggaagtaaatggtcaaggtatatgacctccactttgacaagcctatttccagatctctcccatagatttaggtgttagatttagaaattatttctgaattaaatggggtcaagaccaaagacagacagagtaaatttgccgatcgtgtcaatcatgtagatctcatgcacgtcaaagccattatttttcttttttgttttttgtttgtgacagagtcttgctcccaggctgaagtgcaatgacgtgatttcagctcactgcaacctctgcctcctgggttcaagtgattctcctgcctcagcctcccgaggagctaggattacaggtggctgccaccacgcccagctaatttttgtatttttagtagagatggagtttcatcatgttgaccaggctggtctcgaactcctgaccttgggtggtccacctgcttcggcctcctaaaattctgggactacaggcgtgagccactgtgcctggccaaagccattatttttcataaacacattgaaaatccactaggcagcaaaggagaaagacaggagaaaaagtatgaaaaacctcattgtttatttgtcttaagacaaattacagtggccacaggatctgcacccttcctgaaatctcagggcttcataaaaacccaacattttcagaatacgcctggcacagagacaacctcgaagtcaaagccccaactctgtcaagaccaagacgggagcacaaaggtggcatccttgaaatgaaattcaggtatcttgggtacttctgggtatctctagggcttggggttcctaagcttaactaagatacttgcttgtttaaaggctctggaagcagaaaatccacactatccttcacaggtcacagcttggtatttaccaatctcgtgagcctgaaatttaagttcctttatcctttttctttggtctaccatgccaattcctagcccaggttacccccagccacctgcctctggattgctagacagtgctgggattataaaccgcgcctggccactaaagaacttttttttttttgagatggagtcttgctctgtcgcccaggctggagtgcagtggcgcaatctccactcactgcaagctccgcctcctgggttcacgccattctcctgccttagcgtcccgagtagctgggactacaggcgtccgccaccatgccaggcaatttttttgtatttttagtagagacggggtttcaccatcttagccaggatggtctcgatctcctgacctcgtgatccacctgcctcagcctcccaaagtgctgggattacaggtgtgagccaccgcgcccggcccctttgtttcttaaaaccaagattggaatgaacttcaacttgcctgtcacattaccttatggtgccttttaccacctcctctttttcatcatgaaatatctttgtagccttaactattatttccttccttctattctgctgtgattccactgcaaatcttccctgatctctggagtccaacccgaccaggtccttccagtccccttctctttcacttacttgtctctccccactgctgtccccacggcacacctgcctccatcactttcatatctttctcttattaaatttatttttaaggccgggcatagtggctcacacgtgtaatcccagcaccttgggaggccaaggtgggcagatcacttgaggtcaggagttcaagaccagcctggccaacatggtcaaaccctgtctctacaaaaaatacaaacattagataggaatggtggcacatgcctgtaatcccagctatctgggaggctgagtcaggagaatcacttgaacccaggaggcagaggttgggacagggcgagactctgtctccaaaaaaaaccaattatttttaattttttaaaaatagagatgggatctcactatgtggcccaggctgttcttcaactcctggcctcaagtgatcctcccaccctggcctcccaaagtgttggggttacaagcgtgagctgccacacctggcctcctatctttactccctttctacttggaaacctacacatgctgtattctctccaatcaaacaagaacaagaacagtaacacttgccttggttctactgcctttttgatgtgccatccttccattcattacccaatttcctgaagaatcatttaaatgtgttctctggcccttgcttgagcacctctggcactgtggacagctggctctgattgttagagaagatggtcattattttgagccttttaaatagatcccttgtggttcttgcctactggtcttagtgtcaccttgtgaggtcacacagagcaagtttaattccctgatgcagacaaccttttcctgtcctggcctcctctctcagtctgatctttctgagctaggaactgccagtttcttcaactctttttcacaggctctgcctctgagtcccctttgccttcctgtttccagtttgactctcttcttaaaatgtcatggcccaatattaaatgtgaattatccacatctgctctgtctcccacagtacagcaggattctcacctctttgttctcctcattacacttttgcccagtacaattgtgaaagcctccacccattaactgaaacctctaagacagcggttcagaaagtgtggctcatggagctcctacttcagaatgacccagagagcttcatgttatggactgaaagtttgtgtcctcccaaaagagggtggaactgaatgtgtaggtattttgatcacagcctccagaactgtgagaaataaatgtctgttgattgggccacctagtctatgatattttgtgatagcagtctgagctatctaagacactttaataaatggagattcttggtccacacctcaaacttgaatctgacaatctggggtagcacctgggaatccacattttaaacatttatgccaggtgactttttctttgttttttttttgagatgggatcttgctgtgttgcctaggctggagtacagtagtatgatcagagctcactgcagcctcaaactcctgggctcaaatgatccttccacgtcagcctccccagtagctgggattatcggcatacaccaccatgcctggctaatttttaaaaacattattttgtagggacagggtcttgctatgttgaccaggctctggtctcgaactcctggcctcaagcaatcctcccgccttggcctcccaaagtgctgggatttctggtgtgagccactgtgctcagccaggtgattcttaaatgtgcccaaaagtctgaaaagaaaaaagcttcaggtcttttctaatacttcttaccaagcctggctccctccacccgagtttgtgcagatgggttttcaggtccaaggtcaagacctgccattttcttgtgttacatttcaccttgctagatttggtgcattgccttggtctatcaaaaatcttttgaattctttatcttgcaacatatgatgtcatgataatcacacatggactaccaaaacctcactgtcccagcaccagaaatctcctccacattgataccaatcactaactaatttgtacttcatctttcatcttcttttccatgagataaatgagcaaattgtctttctttctttcttttttttttttttgagacagagttttgctcttgttgcctaggctggagtgcaatggcacaatctctgctctctgctcaccacaatcttcgcctcccaggttcaagcaattctcttgcctcagcctcctgagtagctggaattacaggcatgcgccaccatgcccggctaattttgtatttttagtagagacggggtttctccatgttggtcaggctggtctcgaactcctgaactcaggtgatctgcccatctcgacctcccaaagtgctgggattacaggcatgagccactgtgcccggcccaaattgtctttaaccatattatcaaatgcctcactaaagcccagctcttctttgtattctctatttccctgttccactggtagatgccaattctgtcaaaaaagaaaataaagtgttctcacaggccatttacacatgcattctagaatctgtggtcaggcaatggactctagtgtgcagaactcacccttttttccagtgacgttgttctggatgtttatggcacttatgtcataggacccttgacttgtaattataaatgttcttgtccacatctttttttttttttttttttgagacggagtctcactccatcacccaagctggagtgcggtggcacgatcttggctcactgcaacctctgcctcccaggttcaagggatcctcctgcctcagcctcctgggtagctgagactacaggtgtgtaccaccacacccagctaatttttatatttttactagagacggggtttcaccatgttggccgggctgttcttgaattcctgacctcaggtgatccacccgcctcagtctctcaaagtgctgggattacaggtgtgagccaccgcatccagccctcgtctacatcttgattcaactacgagataaggagctcctgaactctgagcttttatcttaggtgcctcaaaatatctcatggtaactagcacaagatcctacttggtaacctttctttgaatgaatgaatttttttttctcttttttgagagggagtctctctatgttgcccagcctggagtgcagtggcgcgatcttggctcactgcaagctccgcctcctgggttcacgccattcttctgcctcagcctcccgaatagctgggactacaggcgcccgctaccacgcccggctaattttttttgtatttttagtagagatggggtttcaccgtgttagccaggatggtctcgatctcctgacctcaggatccgcctgccttggcctcccagagtgctgggattacagacgtgagccaccgtgcccagccaaatgaatgaattttacattttattcccattaacttactttctttttttttgtataagatgaaagcagatcctggagtgaatactggaagactaagctccctaggcacgagggaagtggtgtgcctgggcagatctcagcagtcccaattgtttctcttagtcactgctcataaaaatcagctccttagaataaaagcagtctttgaaatgcagtgtgatgaaatcacagaaaggatgacacagtttctgaaacatcacaacattactggaatctgtagtaatggccaaagagacacaggaaacagtatttaaaacaaaacaaaacaaaacctggccaggcgcagtggctcatgcctgtaatcttagcactttgggaggccgaggtggacggattacttgaggtcaggagttcaagaccagcctggccaacatggtgaaactccatctctactaaaaaaaaaaaaaaaaaaaaaaaatacaaaaattagctgggcttggtggcgggtgcctgtaatcccagctacttgggaggctaaggcaggaggatcacttgaacccaggaggtagaggttgcagtgagccaagaccatgccattgcactccagcctgggcaacaagagcaaaactccgtctcaaaaaagcgaaacaaaaaaaccccaacaccttaccttagtagagccatctaagtcagcataacatgcagataaaacctgagttatgagcttactgctaatgagacctcttgtgatggcacaaagtgtgtcggtaggatgtgacatggctggacagggacatctggcttttctctccattatggttcccttctgtatcacaactggtaacacatctgaataattatctgatatataaaacacaaagggtgaaaagctgtaaatgaatggtggaaagtcttgtggttttcatggtcaagtgactttctttgtagtcatgcctttcctatttctttttttattttttgagacagggtctcactttgttgcccaggatagagtacagtggtgcaatcttggctcactgcagcctcgacctctcgggctcaagccatcctctcacctcagccttctgagtacctgggactacaggtgcgcaccatcacacctggttaactgttgtgttttttatagagatgcgtttttgccatgtggcccaggctggtctcaaactcctgggctcaagcgatctgcccgcctcagcctcccaagtgctgggattacaggtgtgagccaccatgcccggcctttcctatttctttcctataggccagagaagattccacagataccccagaacatgcctccactggaaagaccacacagccccagggtgacacacctgttctacgtgaggtctagggccatggttctcaactggggctgactttgccccccacatcccaagggacatttggaagtgtctggagacatttctagtagtgacaaccgacatctcatgagtagaggccacgattctgataaatatttggcaatgcacaagacacattacctccaccaacaaggaattatctggctcaaaatgccaatagcaatgatcttaataaaaatgtcatcaatgaaagcctttaagatctagaacaagaaaagaatgcacactttcaccatttttattcttgacaaagttgaagtcctagccagagaaattaggcaagagaaagaaataaagtgcatccaaactggaaaggaagaagtcaaattattactgtttgtagatgacctattttagaaaaacttagaaacaccaccaaaataacctgttagaaatgataaacaaattcagtgaagttgcaggatacacaatcaacattaaaaaattagtagcatttatatacaacaacagcaaacaatctgaaaaagaatgtaagaaagcaatcccacagctacaaaaatataaaatacctaggactaaattttttttttttttttttttttttgagatggagtcttgctctgtcacccaggctggagtgcagtggcacgatctcggctcactgcaagctccacttcccgggttcacaccattctcccacctcagcctcccaggctgagactacaggtgcctgccaccatgcccggctaattttgttttgtatttttagtagagatggggtttcaccgtgttagccaggatggtctcgatctcctggcctcgtgatccgcccacctcagcctcccaaaatgctgggatgacaggcatgagccaccgcgtctggccatacctagaaataaatttaaccaaatacatgaaagatctctacaaggaatactataaagcactgatgaaggaaattaaggaggacacaaaaagatcaaagatagcccatgctcatggattgaaagaattaatgttaaaatgtcaagagtactacccgaagcaatttacagactcaatgcaacccttatcaaaataccagatgtattctgcacagaaatagaaaaaaaaagtcctagaaccacaaaagaccccaaatagcaaagcaaacatgaacaacaagaacaaagctggaggcactgcactacctgacttcaaaatatactacaaagccatagtaaccaaaacagcatggtactagcatagaaacagccacatagaccaatggaacagaatagaaaaccagaaataagtccacacatttacagcatttacaactcattttattattattgtttttttgagatggagttttgctcttgttgcccgggctggagtgtaatggcacaatcttggctcactgcaacctctgcctcccagcaagtgattctcctgcctcagcctccagagtagctgggactacaggtgtgcaccaccacgcccagctaatttagagatggggtttcactatgttggtcaggctggtcttgaattcctgacctctagtgatccgcctgcctcggcctcccaaagtgctgagattacaggcatgaaccaccactcctgggctacaactcattttcaacaaaaaacatgcactgggcaaaggacagtctcttcaataaatgtgactgggaaaattagataaccatatgcagaagcataaagctagacccctatctttcaccataaataaacatcaatcaaaatagactaaagactaaatctaagacctgaaactatgaaactcctagaagaaaacattagggaaacacttcaggacattggtctgggcaaaaattttgggaatgagactttaaaagcacaggcatcaaaagcaaaattagaaaaatggaattacattaagccaggaagcttctgtacagcaaaggaaacaattagcaaagtgaaaaaacaacctacaagaatgggggaaaatatttgcaaactatgcatctgacaagagatcagtaaccagaatatataaggaactcaaacaactcaattgcaaaaaaaaaaaaaaaaaaaaaaatcaaattaaaaatgggcaaaagatctagacagacagacatttctcaaaagaagacatatgtatgacaaatggccaacaagtatatttttaaaatgccatttaaaaatgctccacatcattaattgtccaagaaatgcaaatcaaaaccacaacgagatatcttaccccagttagaatggcttttatcaaaacgacaaaaaatagcaaatgctggtaaagttgcagaaaaaggggaacccacgtgcactgttggtgggaatgtaaattagtacagcctctatggaaaagtggaggttcctcaaaagtctaaaaatagaactaccatatgatctgacagtgccactggtgggtgtatgtcgcaaagaaaggaaatcagtatattgaagagaaatctgcacttccatgtttattgtggcattactcacaatagcaaagatatggaatccacctaagtgtccatcaatggatgaatggataaagaaaatgtggtatatatacacaatggaatattactcagctacaaaaaaagaattaaatcctgtcatttgaagcaacatgaatgaaaatggactatcgttagcaataattttatgtatagttcacagtatctagggccaggcatggtggctcatactggtaattccagaactttgggaagctgaggcagggagattgcttgaatacaggagttcaagaccagcctgggcaacatgacaaaaccccatctgtacaaaaaatacaaaaattagctaggtgtggtggcatgcacctgtgctctcagctactcgggaggctgaggtgggaggattgtttgagtccaggaggttgaggctgcaatgagctgtgatgacaccactgcactccatcctgggtcaaagaacaagaccctgtctcaaaaaacaaaacaaaacagaaaaccaaaaccacaaaacaacaaaatagccagaagagaagaactggaatgctcccaacataagaaaatacaaatgtttgaggtgacaggtatcccagttaccctgatgagatcattacccattgttcacatgtatcaaaatattacatgtgccccccgaaataggtacaactattatttatcaattagaaaaacactaaaaacttttaaaaatttaattaaaaagtataatgaatactgccatggagaattcctggtctacgaacacagtactagtcctaaaactagacaggctggtccatctcaaagggtcatgtaactaactacctgttgtgggtttgtgaagtaagtcacagatggcaaactgtgaggtttaactggggcctctgaggatccgggaatgtgacgtgaatatgaaaccaacgtacccagcgggacaacaagaggtacagcttttcaggctaactccaggaaagtccttgtcttacagaggcacaagggaacctcatttctcctaaagcccctagacaacagatatgttttccccaaactgccattctttttgatatagccaagattttaaacatcaccagttttagatatcacagggaagctgctggatttaatgaagcctcaagatgtcccctgagagatgattataactctaattaaaaatggggggtgatggacaagaatcccctgggactctaagcaactggcatttgtgcatcttttttcatggagaagatgactttttaatgtcagtttgggctctttccaggagtcaaggatagtgtccccaaagtctaatacattttgagatttaatgtggttcaaggatcaggaaatgtcttaaattgtaagggacaaagaagtttacaagccaagccaaactttcatttctctctcttttttttttttctgagatggagtctcgctcttgtcatccaggctggagtgcagtgatatggtcttggctcactgcaacctccagcttcccgggttcaaatgattctcctgcctcagcctcctgagtaactgggattataggcatccaccaccacgcctggctgattttgtatttttagtagagatggggtttctccatgttggccaggctggtctcgaactcctgacctcaggtgattcacccgccttaacctcccaaagtgctgggattataggcgtgaaccactgcacctggcctaaactttcatttcatttttttttttctttttttttgagagagggtctccctctgccacccaggctggagcacagcggagtgatcatagctcactgcggcctcaaactcctgggctcaagcaatccttccacctcagccctctgcacggctgggatcacagctgtgtgccaccatgcccagctaatttttgtattttgtatttttcgtagagatggggtttcaccgtgttaccccagctggtctcaaactcctgggctcaagcgatccacatgcctcagtctctcaaagtgctgaaatacaggcatgaaccactgtgcctgccacatttcttttatttcatatacctgtacttaccatctccatgattgcatgaagcctagaatataagaaaccacctaaatgaattctatctgcatgtcgattctaggtatggataagaacaaaggagaaatgagtgtggcagaatgaggattagagttccatgctcaggcaagtttttggggatcaggtaggtacggcaggtcacagtaggtagtgagggcatggatccaggtaactaaatgagagttaaaacattctcaggtacatcctgaagttcaaggcaggagatcagagagactgagacaccagtgtcagaaagcagaccactgacaggagctcatcttatcacaagaagtctggtcttctaacctcatagtgctggccatgcccactactcattggacagtcttgaccctacatagatcctgaaagggaagtcagactgtttagtatccatggtgggggtccagggcaggtggcagccagagaaagcacgaggcagaaaggcacagctcgttgaaggccttaggattggatggggcctctgcatttgaacttaacatagccctgggtgaggatctcagtagcctcagacagacactcacttccaaaggcaaaggtaatgttacacctttttttaaattttaattttaattaattaattgattttttgagacagagtcttgctctgtcgcccaggctggagtgcagtgacgcgatctcagctcactgcaacctccgcctcccaggttcaagcaattctcctgcttcagcctcccgagtagctgggattacaggtacctgccaccacccccagctaatttttgtatttttaataaagacgaggtttcactctgttggccaggctggcctcaaactcctgacctcaggtgatccacgtaaagtggatcctaaagtgctgggattacaggcgtgagccgctgcacccggtctaatgttatacctttagattgtgtccttgcatctcattactccatgaacatatttttaccgaggaaaaatcaaacagcacagagctgggccaccatgaagccaactgtgtcaccgaacaagggtctaatgcaagcaacatcagggatgccactgtgattaagtgatggatgcagtgaccacactatccattgaccctgcactgactggcatgaatcagggcaggtctctgacaacaggaatcctgtgattcaagattcatccctggataggatgaatgtaccagggaaggctctcatccttgcagacacagagcctgaggcaccatgctgccctgggagactgacctgcaggctttactaatgatcgtcaagccttttgttaatgactggcaagatttgaagattcccctattagtgttcaaggctggggaattatctgtaggatataaggatgaagaaatattcctgaaccgaagctgtgcttgctttaaggctagtggcccccaagctcatctccagtcttgattgcttcccagatcctacacacaatgcacaaaatacctacctgtgatgcccaaatagggcatgtgtcctctcctgacaatgccttgcctgcaacaatatcaacccctccaggctgaggcactttttttcctaatccgtgctctccaagttcactgtaataactgtatttaaactatatctgtggggccgggcttggtggctcacacctgtaatcccagcacttcgggaggccaaggtgggcagatcccttgagctcaggagtttgagaccagcctctgcaacatggggaaaccccatctctatgaaaaatacaaaaattagccagcatggtggcatgcgcccatggtcccagctactcaggaggctgaggtgggaggatggcttgagcctgggaggcggaggttgcagtgggctgagatggtggcactgcactccaacctgggtgacagagaccctgtctcaaattaagtaaataaataaataaagtacatttgttgttgtgtacttggttatctttttcataaggcaaaaagtattctgagctcagggaccatttgtttaaatatatgagtgccacgtgcttatcacagtgcctatcacatagtatttgctcaataaatgtctatggaagcaagaaagggagggaaagcgggctggatgttaaagaagcagtaaagggtggggcgtggtggttcatgcctgtaatcccagcactttgggaggccaaggcaggcagattgcttgagcccaggagttcgagaccagcctgggcaacatggtgaaaactggcctctacagaaaaaaaaaaaaacaaaacaaaaaacatacaaaacattagccaggtgtactggtgtgcatctgtagtcctagctacttgagaggctgaggtgggagaatcacttgagcccaagaggtcaaggctgcagtgaaccatgattgcaccactgtactccagcctgggagacagagtaagatcccatattgaaaaaaaaaaaaaaaaaaggcaaggcatggtggctcatacctgtaatcccagcactttgggaggctgtggctagcggatcacaaggtcaggagataaagaccatcctggctaacacggtaaaaccccgtctctactaaaaatacaaaaaattaaccaggcatggtggcgggtgcctgtagtcccagctactcgggaggctgaggcaaaagaatggcatgaacccgggaggtggggcttgcagtgagtggagatcacgccactgtactccagcctgggcggcagagtgagactccgtctcggaaaaaaaaaaaaagaaagcggggaaaaaaaaaaaagcagtaaagaccactaatcaggcagccagcagtgtcacgcttttccaaaaggggcattggcagtaagcctgggagagacaaccttatggagatcaacaaaggagttggcaatggctttcagtggctgcagggctgtgattcccactgtgcctattggcggaaccccagggaatccctctttcttggatcagccagggacttaccttcctcgaaggccagcacacactcctgtgctggcgacacttctgcagagctggccagcagtagcctgaggttggctatgtcaaatggtccctagcatctcagagactgagccttgctcaatcccatctttatcctgtcagtttcctctgaggaccctgatatttgatattatgaccccaaatagttaaccttagttgtggtgaattgcattcatttattttacgatcttcatgggatgaaagagtttgtcgagctgagtcttcattcagaaattcgcaaaatatagcatttgacagtgccacttaattttcaaaatactatccaatggccacaaggatcactgtagctgaaaaccctgagaatatctataagggtatttcgagacgctagaatgtgatgacataggtctcttctactttcccctcaccttagcaaaccaatacattcagtattcaggatattcaacagaacattcagcacatatccttaactgctcttagaaattggttctgccgatatattagctattcagagaaagtgcttttaagttcattgttgaacatagtgatgtagtgtcttgcaatcacagaatcaacgaatgtttgagctcgaagatttcttatagacaggctagtgtgaattaaggacactaatgcccagctaaaaagggaaagtcacttagtaacttgcccaagaacacgcagctagtgcgtagttgaaccagacttgaaagcaaacatcatgatcataagccacctttctgccactgcgtgttgatggtatgaagataccatatatatatttacacatgcacacacaaaaaaggataaagtcttgcatcacatagagccagttgtctgaagaaactgtcagccctactgaaacaatatcccatttaagtttaagacagcctggtgaggcccagagcctcaccagtcccccagaaaacggagtattgtttccatccaaaccttgcactgaaaggagcctgtcagcaggaagtgacctcgtgagacaactgtggggagagcaaagggccggggagagaaaggcctcattctcactgcaaacaggaaaaggaaagagaaaaagcaagctctgtctccacacaaggtttgctgggctggctatgaactgttccagtacgttccatcaaatagacgccttcatagaatcaagccgagcgcgaacgccgtgtctggggctcccactcccgggacacacacgcgggctggcttacacatgctcttgctctctcgcgctctgggagagcgcttatatgggcttcatgaggctaagtaataaacactttgtcttcaccctgctatttatgggttgcttggggcatcctgtgctctccactgcccttacctgaacagacggctcatgcagacccggagtttaatagggacaacagtaaatctgagaggctgtgtgtgtcccacgcgctcctgttttcccagccacccatgctagttgcagagaaaagccaacctgtatcccttcgtttatgctctgtgtgcccttcctggaggtgaaatcccttctcctttttcttcgggcccttgttttcttccatcctttcaaacatctctctaacatatccttttgctatttgacccctcccagagatcccttcattcttcagcaatggatcaaagaactctgaaaacaagaacaaccccgacagctgcaaaccacgagccctcacctccagcagaggttttcgggaaactctggacgaccacgcgcatgcagaggtaagggaatgatccggtcctacctggcgttgacttccaggttcactcaaaggccacgtgccaccctttgcacatcgtgtttgggttgcaaaggggaaagatgcatattgaaagccagaagtgtgcccaggccaacagacgtctgaaagccacaggggacgaccctgaaaaagtctggcagatgcagaaccacagctgatcactttggtccgtttgagggcccctttcgctcagctcttttgggggttccagggctctcagagcttccaggtcctgtaagaagagatggagtcatagctgcgccctgtccactctcgggctgtcacacaagcctggagcccagccatttctcggccttgtcttcatcttgggctaaccggtcgtctcctgcaaacagacagcacggagaaggatgagtgaactcggcctctccccacagaatacagttcgccattacagcgctgattaaatacaggacattatctcaccataatgccctcctggcggcgttcccaggaaaattctaactaatcataaaaatagaaagaaaaacgcaacctaaattccattcctcgtcttaaatgagtgatgtgttcacttttatttatttttctggaagcgaggcgggaaaagaaaatgaattttagggcttagaaaaacaagctactaatagtactaagtagagctggggcggtggtgcagacagcttagctctagcagggatgtagccggcatggcacgggtgagtcctggccctgctcctggctgaaaacttaagagtttagaactggagcacctggcagggcaaaggcaggatggggtgagggaaagttgtggggttgagtgtggacccccccaaccccctacaaatgcacacacaagctaggcgctcaatagctttcttatagcccaggtaggcaaatcctcttccaatatacctttgaaaataatgcctgatctttctccagcagcattctttttggaaacacaggcatagtttaggtatttttctccctggaaggttctttcctggaagttcacccaattaattcctactcacacattttagagatctgaacagtaagaagccttctctaagaacccctaccctgactccagtccaggggctggtcctgtaaaccttctcttcataacagccatgtgactgtaattaatgcaataactgcatagttgattgtttaacatggttgtctgtcccctcccttagattaaaaatgtgtttgtcttattcctgactttgtaagtactaggtacaaagtagctgcccaatacatgcctgtgttggatgagtgctgacgggtcacggtgggcgccaaagtggatggtaccttatgctacttcggtggggctcaggtgtagcagcaacaaacacatgtagaaccagatcacggtgggtccacaccaacaaggaccaaggaccaagctcctccctaacaatttctgctccttcctcctgtgaagtgttttttgtcgttgttgttgctgttgttattttttgatggagtcttgcttttttgcccaggctggagtgcagaggtacgaacttgactcactgcagcctccaccttctgggttcaagtgattctcctgcttcagcctcctgagtagctgggactgcagatgtacaccgtcatgtccggctaatttttgtatttttatagagatagggttttcctcatgttagccaggctagtctcaaactcctgacctcaggtgatctgcccacctcagcctcctaaagcgttgggattacaggcatgagccactgtgcgcagctccttctgtgaagtcttcatagataaaccatgggagagttaaaaatcctgaaaaccagcttctgaaatgcttatctttttttactttttattttaaatagagacaagggtcttgctgtgttgcctaggctggtctcaaactcctgagctcaagtgatcctcccactttggcctcccaaagtgctgggactacaggcatgagccactgcgcctggctctgggatgcttctcttaatattatactggatgaaaagaaaataaaagacatcccacacccatcttgcctctccctgtccccagtctggcataagaatcccacactgccagcccccatcttagctactgctgaagtaatgggcactgctactagatggcaaagttctagctgggctaattaagcagactgagctaataaccttccattttgggactggtgttattcataatttaatgtattgctgctgaaacattaacctttcgacaactggcatgttgcccacagcggcccaagtgctgaccatctttcagtaaaatgagtattattgttaaaacaggtataaatcattcatggctgcagcttttgtgtcagaccttacgtgaaagtacgcagtaagctgggtaatttatttactttttggtgattattttttatgattttatcatcatattcaatgattcataaacattggcctgatgccatttggtaatcattttacattttaaatattgtgtggctgttctgcttttcatctttaaaaacttcaggattgataccgggcaacttaattcagacacaaatgcaatttcatttgaaagaaggcggtgggtggagggggaaaagaatcccggccccttctttttaataaaccattttcaacagagctgttaggagcttccacttgttacaacattgcacttactgtagcaaactttctttgaagtttaacacacagagggtgccttgaaatctgaataaaagcacaggaaaacagttaacaagcttctggttggaaagacgatgtgattgagccaagggtggagaggggcctggagatgctggccccgggccaagaaggttggaagccactagccctcctcccagcacctggttggggaatgtgattacagtcccccagggacctggaaactctttactgcctgcctgcctgcctgctccggctgcctgccccgaattgggctcctataactgttccagaaagtagcttttgctccttatgactcccagtgctggagaccgggtggtggctgggtctttcatggtctgggagctcaggggatctccctccatctcgtaggcgctcttacagcagccctgcacatttcctaaaccaatgaaaactcagaggtcttcgtatgcaatagctgaagccgaacttctttatttttttttttgagacagagtctcactctgtcacccagggtggagtgcagtgatgcgatctcagctcattgtaacctccacctcctgggttcaagcgattcttgtacttcagcctcccaagtagctgggattataggtgtgcaccatgaagcccagctaattttttttttttttttagtagagacggggtttcaccttttggccaggctggtctcaaactcctgacctcaagggatccacctgcctcagcctccccaaatgctgggattacagggggattgcaggcacaagccaccatgcccggcattgaagctgaacttctgatggtgggaagggagtgggacaggagaaggcagagaatggggcatcatgttaaaactcttcttcaaggcagaagtatgcccgggagtaagcttgcctttagaacctcatttcatgtcaggtgtgctgggacagaggggaactcagtcaagaagactggcacctttgcccaaaacacaggagatgagatcttaaaacacagccataagtatgtgctgtaaagaaacggccacagggaaagccaaggcaagaggagaaatattttttctttgcatctcatctcatctcttctcttctctttctctgtctctctccccctccttccctcccttccttctttcgaggtggggtcttgttctgtcacccaggctggagtgcagtggcaccatcacaactctctgcagcctcaacctcccaggctcaagcagttcttctgcctcagcctcccaagtagctgggactagaggtgcttgcctcctcaccacacccagctaattttaattttttttttttttttttgtagagacaggacttgctctgttgcccaggatggtcttgaactcctgttctcaagcaatcctccccacttggcctcccaaagtgctggccatacaggcatgagctgctgagcctggcctagaaagatttctttctggacagtttgaatagggttagctctgagacagctcttactgtcttttctaacttgtttatgtaatttcccatgaatagctttcatgacttttcaactggattatctggttttaggttttacctggatttatatatacatatgtctcaagttatttaatttttcattgtgttaaaatatagacaacataaaatttgccattttacccattgttcagtgtacaattcagtgctgttcatcacactggcagtgttgtgagactatggccacgatctctttccaacatttctcgtcactctaaacgtaaactttttacccattaagcaataagtcctattccctctttccccgtccccgtggcccctccagcccctggaaacctctcatctactttccgtctctatgaatttgctattctgaacatttcacataaatggcgctgtacaatatttgtccctttgtatctggcttctttcactgaacataatgttttcaaggttcatccatgtcataagatgtatctaaccttaattcattttataccaaataatattccactgtatggatataccacattatgtttatccactcccctgttgatggacgcttgggttgttagtctctttggctattggaataatgttgctgtcaacatgagtgtacaagtatctgcgtcccttgtgtatctattttttttttttttgagatggagtctcgctttgtcacccaggctggagtgcagtggcacgatctcagatcactgaaacctctgtctcctgggttcaagcgattctcctgcctcagcctcctgagcagctgggactacaagcatgggccaccagacccagttaatttttttgtatttttagtagagacagggtttcaccatattggccaggctggtctcgaactcctgacctcgtgatccacccgtcacagccttccaaagtgctgggattacaggtgtgagccaccgtgccccacctgttttgtctttgagatggagttttgctctctcacctaggctggagtgcagtggcatgatcttggctcactgcaacctctacctcctgggttcaagtgattctcctccctcagcttcctgagtagctgggatgacaggcacatgccaccacacccggataatttttgtatctttagtagagatggggttttgccatgttggccaggttggtcttgaactcctgacctcaggcgatcctcctaccctggcctcccaaagtgttgggattacaggcgtgagccactgcacctggctgtatatctatgttttgaccatcacattttttttttcatctgatctacctttatcttggatgctctgtttgctagcttggcagagccagcgtgggcacacgtggcaaagccatttatgcctgggaattcctctctgactgtcaacgccgccgcttcaaaggacttcttgcagtcatcctctggcattgccacggctggtgctggttgtgaattctgcaccagcaacctccaccccctacattggacttgataaaacaagctgcttctcaggtatgctaaagaacaaattaagaaacagaatcacctgggatgagtgaaattccctttcaatcatgtcagccggagcagaggttgtcatgaaatttgatgttagggatttatttcctaatatacagtctaaaagggaaaacagtgtaagagctgaaatgtgaattggacatgtctatagagtgtgaattggattcaagacaaaatattgtgaatggttaatagggtcagtctaagtacacttcctgaaataatctcttggatatgcaaatattctgagagctacactgtcaaatagctattgtatcctcttatctatgtgttcacagaacggctacatgttataacaaatgaaaaatgtgaatttaaaaaataatgccaccctaaaataatactttactttgaatagcaatttttgttgtcggagttttttatttttgtcacaccagacagttaggttcttaccacagctttatttggaaacattaagagatgagctctggccgggcacagtggctcacacctgtaatccctgcactttgggaggctgaggcaggtggattacctgtggtcaggagtttgagaccagcctggccaacatggtgaaaccctgtctttactaaaaatacaaaaattagctgggtgtggttgcaggcacctttaatcccagctactcaggaggctgaggcaggagaatagcttgaaccctggaggcagaggttgcagtgagccgagatcacaccacggcactccagcctgggcgacagagtgagactccatctcaaaaaaaaaaaaaaaaaaagagagagagaaatgagctctgtgtgtcctgctctcaggaggaacagacgtggggtgggaaggggaaggagaaagcaggaacaggccaaatgttcagagtcatctgggtcatcgagtctaccatatgcatcagccatgccttggattatcttggaataccttggaacttctccttctggctacctggggccttctcagtggaatccctttcctgggaaccttgcattgtcttgaggacttgagatgctatttaaatgttcaccatctcactatgggtatcagcccattacacatgaggacagggtggggttgggggcaaggggaattcagacgaaagatacctgtggagaagccataggttttactgttgacaattccggggctccaccattgagcctctcattaaaaacattaggaagtagccaaacatactgggttttgttccatttctttttcattccttttcctaatttctgagagttgagctagtgagcagagaaggaatagacagtgcagagaagacagacagctgagggatgaccctgacatactctagaacagcccaaagcccatggtaagtattcaaaaacaccttgatcagacgaacaaataaacatcagccactaggactcaagagctgagacgatctcaccaacgggcatgcctttttctttgatctggcccaggtttgctgggtttgattaactttgcaactctttggcagaatttggttctcagaaatatcaggaagtggcagagtgcaagaaagccccttcaccatacttaaatggagacatctcccagttttctgatttccaggttagaattcaatttccaggaattcccctcttttttttttttttgagacggagtcttagtcttgctctgttacccaggctggagtgcagtggcgcaaccttgcctcactaccacctctgcctcctgggtaatttccacctcccaggttcaagtgattctcctgcctcaacctcccgagtagctgggattacaggcacccaccatcacgcctggctaatttttgtatttttgtagagatggggtttcactatgttggccaggctggtcttgaactcctgacctcaggtgatctgcccatctcggcctcccaatgtgctgagattacatgggtgagtcaccttgcccagccaatttccaggattctctaagaaaggattctgagaattaaacatggaaaacaagggacccccagcacctgactgctgctttctgctttatccatgtccttaggatccaccatgtccttgctctggtgcttcagcaccccctcaacccctgttcattctcaaaccatctaaatccacctgttccaaatcccatcagctctgagtcccgcttgccttcttcttggacaatctgatacaatctcctctgcttcactttcgattcctctccaacctgtttgtaccattagagcactgcagcaccattatatctcaattgtggtccataacccatcttctcaaaatttcaaaatttatttcaaattgatgagccccattcaagatctcctgaatcagaatttctaaggtgggcttcagactcctcagcatcactcataaatttgagaacattgtcttttggcacaagtaatataattaccgtgttgaaaggtattgctccccttttgagatggagtcttgctctgtcacctaggctggagtgcaatggcacgatcttggctcactgcaacttccgtctccctggttcgagcaattctcctgcctcagcctcctgagtagctgggacaacaggcaagcgccaccacgcccagctaattttttaaatttttttaaatttttttttttatttttagtagaggtggggtttcaccatgttggccaggctgggctcgaactcctgacatcaagtgatccgctcacgtcaccctcccatagtgctgggattacaggcgtgagccactgtgcctggccagagtttggcatttcttccagattgtattacatgttcagatttcctgcttcttgacttctttatttttgttaatgacatcactgtttcacagaccctaggcttcaaacctcaaccttccagtcctctgcacccagtacaccaccccttccaacatgcacctcactctagctgggtgctacctcttcagtaatatttcttccattctcacctcttttttttttttttttttgagacaggatctcattctgtcacccaggctggcgtgcactggcgccatctcagctcactgcaatctccgcctcctgggttcaagcgattcttgtgcctcagcctcctgagtagctgggattacaggcacctgccactgcgcctggctaatttttgtgtttttagtagagacgaggttttaccatgttgtccaggctggtctcaaactcctgacctcaggtgagtcgctcacctcagcctcccaaagtgctgggattacaggagtgagccactgtgcctggcctcttccatcctcacgattgctcttgcagatgaagaacttggaaatgttcacctgagctcacctcgagatgccaaatgctgccacttccagtatggaaatccagggtacacattgcccctcttttccggcatctgtccactttgtgaaatacatatctatgcatatgcttttctatttcttccactaggcttgaagctgctggaagtgaatttctttaggtcacctttgcttttctctagcataggaccttgtatatggtgctttgaaaaatatttgttgaattgaacaggtgaatttcttaatcgcaggcccactgctgacatgtagcgatgtgtgtatagatttttgaccttccaaacactttcacagtcataagcatagctagcctttctgtccttggtattgctgactgtcaatttgtctgcatttgctaatatggaaatttgaaaaaaacacacaaaaaaccaccatctgggtttgaggtgagaaccccagctctatcgcttattggacgatctttgataagttccttacctctctaagcctcagtttcatcttctgtaaaagggaagtaataatagtacctctcttacaggttgttataaaggtcaaaagagaaaacaaacgtaagtacttaacgtggttcctggcctaggtcaggcactcagtgaatggtagccattgggtactggtgttcctacatttacatctttgtttgtttgtttttttgagacagagtctcactctgttgccctagctggagtgtggtggtgcaatctcagctcactgcaacctgcacctcccaggttggatcgattctcctgcctcagcctcctgagtagctgggattacaggcacctgctaccaaccctggctaatttttgtatttttggtagacatagggtttcaccatgttggccaagctggtctcgaactcctgaccgcaagtgatccacccgcttccgcctcccaaatcgctgagattacaggcatgatttcctgcgcccagcctattatctttgaaaaggtctctactggctcccatttctactggataaggcttaaaatcctgggccgtgagtatctcaggttcccagccttgtctccccgcctcactcatgtaccccaaccttgggtaccccaaaccagactctgcctcttccttcaacaagtcctgtgcgctcacacctctaggcctgtcctccagcagttccctcctcctggagggtctctcctcccattggtggcccacagaaagatgcttggcgagaattaattacttccttatccttatttccatagctctctgaaccttcctctattacagcactttcacattgcagtacagttaatttgtttttgtatccaaactcctctgtgagtccgtgaactcctcaggggtaggaatcatagctcgtgcctccttttggcccactcacagtgcatgagcattctacggtctgatgaatattttctgtgtttactaaaatgcggagattaagcattaagtcacccaatgattgtggcagtggcctcaatgcctgtccatctggagacctcctataacagtctggtggagacttttatccgtaggcctctttacagagacattttacatagatcatcatcttcctagatcttcagataaaactaggcttgttctggcagatacggtgggaaataatgtagtaaaccaaggcaaggagtttagtgatttgaccaaagttccaaactaactgaaggcactctgattccactggtctatctcccagtctcacggctttgcatggaagctgtgtgatggtggcctccgaggaagaactggccaagtatctttgggacaaagtaaattgacatgttaggttatgaaatgcaccgatctccatccagactgttatgggaggtctccagatggacaggcattgaggccatagccacaatcatccagtaactgaatacttaatctccacgttttggaattatgtgctccctatggatttattttatgtatttatttatttattttattttttctgagacagagtctcgctctgtcacccaggctggagtgcagtagcgcgatcttagttcgatgcaacctccacctcctgggctcaagtgattctggtgcctcagcctcccgagtagctgggattacaggtgcgcaccaccacgtccagctaatttttgtatttttggtagagacagggtttcaccatgttgcccagagtggcctcaactcctggcctcaagtgatccacctgcgtcagcctcccaaagtgctgggattacaggcatgagccaccatgcccagcctcctgtggatttcaatgtgaccatttgggcaaatctctcagtgaaggagtgggacattttctttacgagagactctgggggagtacgtaccacatgaggctggttcatagttcacaggcttagctgtacaagcgtaatgggaacacacagggtctctagaaaagaacctctcagggcctcggttgacttcaggtataggcctgatcctgtatcctcttcacctggctaacttttaacatgtggctgaaaagtggctacttcagaagccttccttggccactccttcaaccccaccattctgtcccccatgtgctcctatagcattttatgttcgcttccatcatcatatggctgaatgatcaaacccaagtctgtccctcacttgactgtgagatccctaaaggcagggacctgtcaagtatgtttgtcactggaccattctgagaagaagaagtgatgcaagcatcctgcggagggaagaggactacaaaacagcaggccactgcagccatcactcactgtgcttggcgatgagctcttgcacaaatatgtccttggccactgctttctttaatagtcagttttttgttgctgggccaggagtggtggctcacgtttgtaatcccagcactttgggaggccaaagtgggaggacggcttgaggccaagagctcaagaccagcctgggcaacacagcgagacactgtctctaattttatatatatatatatgcatatatatatacacacacagacacacacatacatatatatacatatatatacacacacatacacacacacacacgtgtgtatatatatatacacatatatatacacacatatatatatatacacacacacacatatatatatatatacacacacacatatatatatatatacacacacacacatatatatatatattttttcccccaggccaggcgtgctggctcacacctgtaatcccagcactttgggaggcaaagacgggcggatcacttgaggtcaggagtttcaagacccgcctggccaacatggcaaaaccccatctctactaaaagcacaaaaatcagctgggcatggtggcgggcacctataatcccagctacttgggaggctgaggcaggagaatcacttgattctgggaggcggaggttgcaatgggctgagatcgtgccactgcactccagcctgtgtgagagagtgagcctctgtctcaaaaaataaaattaaattaaatatttttgttgttaattaaaacaaaacatttcactgcaatggctttccaagtcaaaaattcttttcatggccctcatgatcatcatgatcgagattcctttagatccagcttttctttcacccccgcatctctcccactccctatatgtacacggaccccctccccccgccccatctcctacctctgtgcttaggctcatgcaatacctgccgcccggaacgccagcctcagagccagggaatcctctccgccatgcaaaacacagtttcaatgtttctcggaagccctcctagacccctcctccctatgacctgttaggggcttctcttggttccctgagctttggctactgcctgacttttctcatgatattccaatgatttctgcccattttgctcaattagagcgcaagatctaggagcaaggatcttgtcttgttcttttttttccatgcccactgctgggtcctaggtggctggatgaattgtaaaataagaatctgtggaatttaacattcttttattatttagtgatggtgaagctttctcagctctgagaagaccttaaatgcccatgctttttgcatggtgtcagtttttgggttccaagacttttgttctagcaggatgagaacccaggattacacaagacggaagatgtacaaactctccctctctaagggtgagtgctcttaaaaggctacaaagggccaagcagtcagatggcttcatgttctatctgatatcatccctttattgtgcccttgggcctggtcaaatcagtcatcccagctcatatgacatttgcagctagtttcatgcaagatgcaaaatcttgcacggcaataactagagaggctgttgtaattctgtgcaagttggaaaaagctgggggccaatttggcctgcatagatgtgactttgtctccaagttcccatcattcatcatggaagccctgccttagaaagtttaagtaatcaaaacatttgtcaactatcaattgacaataatgatggtgcacctgtctagagttagtctgtccacttccaagggtgtcctcgtgtgacagttatgcaacaatgcacttggtcaccacatgagtaatgacaaatgggtccggacactgctatcgtctcagacattattaagttttgctaatggatgggactaacagtccatctaaccggttagcaggtgagtcacttgtaataccaaaaaagcaagcatttaagtatgtattttaaaaatcattcctctctaggctgggtgcagtgcctcatgcctataatcctagtactttgggaggacgaggcaggcagatcacttgaggtcaggagttcgagaccaacatggcgaaatgctgtctctactaaaaatacaaaaacactagctgagtgtggtggtgtgcacctgtaatctcagctactcgggactctgaggcaggagaattgcttaaatctaggaggcagaggttgcagtgtgccaagatcatgccactgcactccagactggacgacagagcaagactctgtctcaaaaaataataaaataaaataaaatataaaataaaaaaattgattcctctttagttttatatatttcatatcaaaccttattgaaaaaaggatataaggcagcttcagaaacaaaaggagatccatgttagaggtgggtgtttaaatataagccctttcttctcaaccgacaaatgttgtcacatctgcatatgacaagatatcactctactggggcatctgctttccctgactcacccaacaaggttgagaattccctcctccacatcactcctgtgcctggaacaaacctgttctgtagcgtagctcctatggcattttgagtctttattcccatgctgtgagcatcttgagggcagcaccacgcgtatttggtttggaaccccaagcacctagcacaggttttcaatcaagaatgatgataatgggctgggtgtggtggctcacacctgtaatcccactttgggaggccaaggtagcagggtcgctgagcctaggagtttgagggcagcctgagcaacatagtgagacttcgtctctacagaaaattttaaaaattagctgggtatgggctgggcgcagtggctcatgcctgtaatcccagcactttgggaggctgaggcgggcggatcacgaggtcaggagatcgagaccatcttggctaacacagtgaaacccagtctctactaaaaatacaaaaaattagccaggcgtggtggcgggcacctgtagtcccagctactcgggaggccgaggcaggagaatggcatgaacccaggaggcagagcttgcagtgagccgagattgtgccactgcactccagcctgggcgacagagcaagattccatctcaaataaacaacaacaacaacaaaattagctgggtatggtggtgtgcccccgtggtcccagctgctcaagaggctgaggtgggaggattgcttgggcctgggaggttgaggctgcagtgagtggtgatcatgccactgcacttcagcttgggtgacagagcaagaccttaccttaaaaaaaaaagagagagagagaataatgatgatgatgaggaggaggaagacgatgaagaggagaaggatgtatattattttttgtttgttttgagggtattgctctgttgcctaggctagagtgcagtggtgggatcacggctcactgcagcctcaaactcctaggctcaagtgatcctcccaccttgacctcacaaagtgctgggattacacccagtggatgtatgttattgtgtaaactaaattttggatatcttctcctccatctagatccccttctctgccggtcctggagcacacccaccagtacctctctggccccctccccatcaggccctgtggagtgcggggcacagtcctgaagtgactctggccttctccactgtggttctaacagggttaaagttgaggtttctaatcactcccatgaggtcttattacctgttgattaggtccttttgggatcagcatcaaaccgaaaacaataataaacactcccttcattggaactcagtaatgaccctgcctgccctgcaggcctggtggcgatggggaggggctctggccgttatggggctggaaacagcagcccttgttgggggcgtttgccagcgatttggtggtgcagcaaagaggtgcggctaacaagctgataggcactggttggggattctggctggccggaggcatccctgttgttccagcacaaggctcttcagaggggaccctccacagccagcctgaggacttgagagatggagctgggtggtctttccgcaggactagaggaatttctagagaatgatctggtaactgtttcacgtgtatttttccagactttttcctgtgcacattcaaatgtgagtgagtgaatgaggatgtgaacgcatgcgtgtgcataggtttcgtgtctttattacaaaaatgcaatcataggaaacattttgttctgtaaattgcttttttttcacccaacagtccatctcagacacccttccatgtcattctgttgaagcgcttcgtattaatccagaatatgaacaaagccaaatacatttaaccaacataaatgtgattgaacattttggccatctccacccgtttcttggtatcacaaataaagctgcagtgcttgctctgccagcgcatgcactaaaatcagcacgacacaggttacgtggctcctgcgcaggatggatacacaaactcgtgaagcattccgtattttttttgtttaaaaattttccggtgcagtgcctcgtgcctgtaatttgggaggccaaggcaggtgaattgcttgaggccagcagttcaagatcagcctggtcaacagggtgaaagcccatctctacaaaaaccacaaaaattagctgagtatggtggtgcacacctgtagtcccagctacttgggaggctgaggcacgagagtcacttgaacctgggaggcagaggtagcagtgagccaagatcaaaccactgtactccagactgggcaacagagcgagacttggtctcaaaacaaaaacaaaaacaaaaacaaaaacaaaaaaccaccaaaacttttcatattaaaagcttttcaaagtaaacaaaactaatgatacgacattaaagagtttcatttgggcggggcgcagtggctcatgcctgtaatcccagcactttgggaggctgaggcgggcagatcatgaggtcaggagatcgagaccatcctggctcacatggtgaaaccccatctctactaaaaatacaaaaagctactcaggaggctgaggcaggagaatggcgtgaacctgggaggtggagcttgcagtgagctgagattgcgccactgcactccagcctgggtgacagagcgagactgtctcaaaaaaaaaaaaagaagagtttcatttgttttacttttaaatcctaaaaatccttatacattttctcatgtacttgtgcaagtatctcagtaagatacattcaaacaggttgtgtctatttgcacatgaaacagtagtatctgagtatgccctttccttggtccttggataatataattttgtttgtgacaattcaattgtaataaaagatacatcagtgatattttaacctgaatttccctgacatgactttgtatttattatgtaattttaaaaacatatataattcaagttttaagaaaaattacaaaaaacactcctaaaatttccatacactctttacacaggatcactaattctttgtattttgtcccagctttttttggagacagggtcttgctctgtcacccatgctgaagtacagtggctcgatcatagctcagcctcaacctcctgggtccaaatgatcctcccacccctgcctcccgagtagctgggactacaggtgcgtatcaacacagccagctaattttttaattttttgtagagatagggtctcccattgttggccagtatggtcttgaagttctgggctcacgtgatctgcctgccttggctttccaaattgctgggattataggtgtgaaccaccgtgcctggcctagcatgttaaactaataaataaacaaatgaccaagttgcagaataataacagtaaggatgcattttatgattttatgattttatgtttttttttgagatggagtctcactctgttgcccaggccagagtacagtggcatgatctcggctcactgcaacctccggctcctgagttcaagcgattctcctgccccagactcctgagtagctgggagtacaggtgcgcaccaccacgcccggctaatttttgtatttttagtagagacgaggtttcaccatgttggtcaggctggtctcgatctcctggcctcaagtgatctgtctgcctcagccttccaaagagttgggattacaggcgtgagccactgcacccggccagcatttttctattatcctattcgattctgcttttgtttttgttttttcccttgagaatgttttgacacattgctagtgaaattaaaaataaataaacacactaatgggaggtctaacaatcatgccagcttaggggaagcagccactatttaaacattaaagaatcaaatacagttacacagcatacacagaataaaagttgacctgggggctcttgctgtctataggaaattgcaccaacccattcagaaaggaataaaaggaactctacactctcctatgtttcaactgccaagctttgctgtttatcctaagtctttacagattccatattctctgtgagggagggagggagggaagaaagaaagacagaaagaaagagagagagaaagaagagagagaaagagaggaaggaaggaaggagagagcgaaagagaggaaggaaggaaggagagagagaaaggaagaaagaaaggaaagaaaagaaaaggacagagggagggaggaaggaagggaggaagggaaggagagagggagggattcgccgtgcacctaacacattctaaacccttgccatatatgctatttcatttagtttttgaaactccaagaagcatttcttgtccccattttatggatgggaaaacgaggtttaacaaattcgtgtaagttctcaaggaacctggattcaaacttagtccttcctgactccaaagcccactgaccgtcctctaccaagaatcgctttagaggggactggagaacaggtttgcagttgtagaatcttacactggtgggtctaggtggtgcatagtccttttcctccttttctagaggtgctctagaaaacacctggggagatgccccgggcatgttggacaaacttctctccagagttttccatttctctctgctcctgtctgcccatggcacctgatctcaagagggataagaaggagagaaaaagggaagacagagaagaagagaggggtgggataatgagagaaagagaggcagaaccccaagcaggagcctacagaggagtcgacacaataggaagacagagaaaaacggaaggaagggaagaagggcagggcctgtgaggcaaggagctttgggagtcctagtctcataaattaaaaggatgacaacaaagccaggcaggaaggatttaaaaaaattttaaaaaggccgaacccagtggctggcacctgtaatcccagcactttgggaggctgaggtgggtggatcacctgaggtcaggagtttgagaccagcctgggcaacatggtgaaaccctgtctctactaaaaatacaaaaattagccgggcgtggtggcacatgtctgtaatcccagctactcgggaggctactgaggcaggagaatctcttgaacccgggaggtggaggttgcagtgagctgagatcgcgccactgcactccagcctgggcgacggcgtgagactccatctcaaaaaaaaaaaaaaaaaaaaaaaaaaagtaagtgctttcccccagtagactgagaaaggggaaggttagtgaagggcggagagaagcagcccagaccccacccacattcctctgcatccagggaggagggtcctagctgctgcccctggggcctggctgaccaggtgagcggctgcacagccccatcggagccaggcccgccctggagttatcctgcacactttggacccagcacccacagcagccctgcgccttggttcactggacaaactttggctcttcagacaaactttgaaaatccctaacttcttagggattttccctaagatccagcaaaccagccggattagtctttgggagaaaggagagagagaatatgagaaagaaagagggaatgagaggaggaagagagaagaggagttagagaaagagaaggtcagaaagaaggagagcaggagaggagggcaagaggcctggagaaagagagtgggagatggaaccaggcgaggaggtggagaagctgccagaggaagtgaagggaggaaggagacattatatattcctaggaaggaacaatataagatctttcaccacgtcccagaggtcaataaactggcctgggaaattaagaacaagttgtcattgaggattagcaaaaggcctgaggaagtacaaaaattcctgccagctttcataaagctgcctctaagaaattaaaaatcacaggccacaataaatacggcccacgtctatccacacccatgtccacatgacagcctggagaatgaggcatccttcgaggccttgctttaatgtgagtaattacaattatgcaagaatcccatgggctataatcatacacccactacgtgagctactgggaagaggcaaggaggtgaatgccagcaacaaatgcacaggaaggaacattctagaagagatatgagaaagtggaattaaacacggatggcgggtcttggttcctactaatggggtatgatgcatccatttctacattacatgggcggaaggttaaaacaaatagtttttctcatgaccaagactcttttttggaaacttttttttttttttttttttagacagagtcttgctgtgtcacccaggctggagtgcagtggcgcgatctctgcttactgcaagctccacctcttgggttcaagccattctcctgcctcagcctccctgagtagctgggactacaggcacccactaccatgcccagctaatttttttgtatttttagtagagatggggtttcaccatgttagccaggatggtctccatctcctgaccttgtgatctgctcgcctcggcctcccaaagtgctgggattaccgacgtgagctgctgtgcccggccatttttttttaagagatgggggtctcactctgttgcccaggctggtctcgaactcctgggctcaagtgaccctcccacttcaacctcccaaagtgttgggattcaggcatgagccaccgtgtctggctggaaactttcaagggaatggattttgcctgtatgttactcattttctgaggctatttggtgatggtctcacactatggttgaagataagttggaattttcttaactaaagttacctttttaatattctttattaatcaccccttaggttgttatcagaaattgggtaaactgtcagtcatggtggttcatgcctgtaatcacagcactttgggaggccaaggtgagaggatcacttgaggccaggagtttaagaccaacctgggcaacatagtgagacccccatctctatgaaaaagatttaaaaactagccaggcatggtggcacatgcctgcagtcccagctactcaggagggtgagctgggaggatcccttgagcccaggaggtcgaggctgtagtgagccatgactgcgtcactgcactccaacctaggcgacacagtgagaccctgtctcaaaaaacgtaaagtaaaataaaaaaaataaaatgggaaaactagcaattttctgcaaggaaataagttttgccaccttgtgaatggccagcctgtctttgatcacaagggcaactcacaggcaaaggattactgctatttcctaattttagtttgtttttaaagagatggggtcttgctgtgttgctcaggctggtctcatactactgggctcaagaaatcctcccacctcagcctcccaagctgtagggactacaggcgcatgccaccatgcctagctgattgcaatttctaccctggggccccaggcccttctatagcgattcctcaagagtctactgtcatagaagcagctgtcttcagcttctctccctaggccttctttgttggccaccagcaattcttggggtagccaatgtcttgaagttcaggaccaactgccggagaaaccagaccctgatcctggctgcccctcatctccaagtctcagcagacgctgctgagttggtgccttgcgggagaccattaagtccgactccagggatccaaggtctaccactgccccaagattacggggtccaggccaggcgtgatggctcatgcctgtaatcccagcactttgggaggcttaggcaggaggctcgcttgagtctaggagtttgagaccagcctggacaacataatgggaccctatctctacaaaaaaaaaaaaaaaaaaaaaatcagctgggtgtggtggcgtgtgcctatagtcccagctatttgggagactgaggtggggaggattgcttgaacctgggaggtcgaggctgcagtgaaccgggatcatgccactgcactccagccagggtgacagaatgagaccctctctgaagagtccaatgtccatacttggcttccttcagcatctcccaccttctagcatctccttgcttctagaaccagatagcaacttttttggagcacctcctcaagggcaggcgtagggctagatgctttacgtctttcatttggccctcacaattataggaggcactgctatagacagtttcacagatgaggaaactgaagcttagtgagataacttgttcaagttcacattgtttgtgatggagccactaatcaagtccagggttgcctggttctaaaaggttgctctggccaggtacagtggctcatgcctgtaatcccagcactttgggaggccaaggaggatggatcatctgaggtgaggagttgcagaacagcctgaccaacatcatggagaaaccccgtctctgttaaaatacaaaattagccgggcgtggtgatgcatgcctgtaatcccagctactcaggaggctgaggcaggggaatcacttgaacccaggaggcggaggttgcggtgagcagagatcatgccagtgtactccagcctgggcaacaagagcgaaactctgtctcaaaaaaaaaaaaaaaaaatgttgctctctgcttccactgcttcatcctgcctttagtgcttatgccctttgggtcttgaaaactgttcctaccttcaagagtctcccagatgaaatccacgtactccagagccgggttgagtgggtgggtggcgggggagtgtcccttgaaaattctgactacctcattaatggggatttgctgacagttactcactcacaggcattttcttaggacaaggagggcttggagaagaaaggctagttctcaagaggaggaatgagagtttgaaccagaaatgtgtaacaaacactccctacattgtggaatcgcaagtggagaaggccagaagtggctggggagggtgccagactccaggctgggaagctggaggcctccattttgctgaggatgaaactgtcattttttgtacctggggatgcagaccatgtacctatcaaagcttagtttagcagaaaaaattcaggatgttggagtgggttggcttcttccagcagccttcaatgaagcactttgggaggcaggctgaaggtgctctgttttccagcaagaagtcaaaggactctggttggctaagagaggttctttccacctgtggcctgtaatttaaatgaccaaaagtcctaaccctgggtactgcagggctggaaaaaccacatttttctatctcaaacccagtttattcacgcaggaatggggagggttctcagaagatgagatgagaacacagaaaaagcctggcctgcctcatcctaggctgtctcccggcttgttctggtgaacattgtctgtctaagcaagggggatgcatgtgctttgtgaagtgtctgggaacagtctgagggcatgaagaaataagaatctgcctacccaaggctattgtctttatttcctacaaagcaaaggctaaaatgaaggaagaggccacacactaggcctgaactaaaggtagtgcttcaaactctaggtatgacacattagtggactataaactcaatttgatggattgttactggcttgttttttcttttctttttccttctttccttccctctttccttccttcttccctccttcccttctttccttccttcctctttcaacagaatagaaactattagcatgtaacccatgtagtggccataaatactgttgtataataaaacttatgatttagttatacataaatacataccaatatgcacatgcataattgtatactaggtcatgaagtaaattcattctcattatgggtcatggccaaaaaatttgaaaactagtagacaggtgaagcatagagatttggggccagaaagtagaaatttccaggttgaaaacacatgatcaaacaaaacctctgactatggttacgacccaatggagttgtctagaggcaaaaatatgaaaagcctattagtttttggggggatgagtattgctaaagaaatggcaagaaagggtgacaatagtctgcaattgtttaaattgttaggtgtactttaggtcaatctctagcctcctgctatagacccaatgtgtccccacctaaattcacatgttaaaatcctaacccctaatatgatggtatttgaaggtgaggcctttgggaggtcattaggtcatgagggtggaaccctcacaaataggattagtgcccttataaaaaaggcctgagagagagctcccttgccccttctaccatatgaggacacagaaaagatgactgtctatgaaccaggaagtgagccctcaccagaaaccaaatctgctggtgccttcatcttggacttcccagcctccagaaccatgtgaaatacatttctgttgtttataagccatccagtctagagttgtttgttatggcagcctgaactaactaagacacccccaaaatcacaccagaggtagtgaattgctaaagcagtacagtcctcagagaatgcatgttcccattgccttcctcagagatgcccatgaaggacagatggacaaagaggaccctctgtggtctatattagataccaagaattctttctattgccagaggtcttaattattttttgttcttagttttttttgttgttgttgagacagtctcactctgttacccaggctagagtgcagtggcacaatttcggctcgctgcaacctccaactcctaggttcaagtgattctcgtgcctcagcctcctgaatagctgggattatagatgtgtgccaccatgcctgcctaatttttgtatttttagtagagatggggtttcatcatgttggccaggctggtcttgaacttttcacctcaggtgatctacctgccccgcctcccaaagtgctgggattacaggtgtgagccaccatgcctggcctatttttttgttcttaggatatgacatgtgcaacttcccatcttcccagagtttttattgtatacctcccattctttcttcagtgtattgggtgtattgggggtagataacttatttaatcacaggtcactggaccactaggagttacctgtgaatttcaagaagaggaatttcacaggatgtagtaattatacaagcctctgggctcttgcatttgagttgcatgcatttttatatgggtatgggtatttgtaagagtgtttctgtggaagataggtatgagtacatgttgagtagccaaaggggtgcacagtacttgacattttttggttgctacccagcacccatgtaactatcctccaccttagcagtatccagattttccttcaggtaattacatccccatgcagcccatggactttgtagcttattccagctgagagccctgaataacttgagccaggcagtaccttttatttccctgattacagtcactcctttcagggtgggcactgtgtcctgggatggtactatcatgtaaatttcaggaatcctacttgaaatgacagtgcagaaacactctctttttaaaattcttttatttttatttttttgagacagggtctcactttgtggcccaggctgcagtgcagtggtgcgatcatggctcactgcagcctcaaacttctgtgctcaagtgatcctcctgcctcagcctcctgagtagctgggaccataggtgcatgccactatgcccagctaaattttaaaacaatttttgtagagatggggccccactatgttgtctaggctggtctccaacttctgggctcaagtgatccttccatctcagcctcccaaagttctgggattacaggtgtgagtcaccacactcagcccggaagcactttctaccatggggctccgcactaaactggcagccacactgtgtctccaaggagggcaggccttaggatgagggcaacattgtggctgatggggtagagaggaaggagggctctgggcccttcattatgctcctgagcgcttggaccaaccagccgtgtggcctgctttacctttgccatgttccatgtgagccaacaggcatccttactgagatctgtttgagttgatttctaacagttacatcataggaaatataaacttcatgtattttattttacgtcttttagaaatggggtcttgctctatcccccaggctggaatgcagtagtgtgatcatatttctgcagccttgaattcctgagttcaagtggctggcttcagcctcctaagtagctgggactacaggcgtgcaacaccttgcatggtttatactttttatttttacattttttgttaggacaggggcttgctatgtttcccaggatatttacaacaaacaaaaaaacctttgttttgcttgaggctgagctttcttattccagatgtggaattgcagagcctctgtcccaggcctccaggaggctgaattcattcccagtgggttttagtggttccagccaggagtctactcctgaaagttcctctgtgctcaatttcccccatactaagtgaaatacacagttgatgtttgttttttttgtttgtttttttcacactcaaggctctttctgtccctgatctatcccttcatgacccttggctcatttcccatttctagtcctgccccttgaatcacagtaatattaagctgtttagagttccacattccatactatttttgttgttgttgttattgttgttagagacagggtcttgctctgtcaccccggctggagtgcacataagtggtgcaatcatagctcattgcagcctcaaactccgaggctcaaatgatcctcctgcttcagcctcctgagtagctgggactacaggcacatgccaccatgctccattaatttttcatatttttatttttttgtagagacagggtctcactccattgcccaggctactctcaaactcctgggctcaagtgatcctttcactttggtctcccaaagttctgggattccaggcatgagccactgtgcctggccaaaccccatacctttcttcatgtgcctttcttgatattgtttttgtttgtttgtttttctgccctatcctctctaccttttttttttttttttttttttgagacagaatctcgctctgtcgcccaggctggagtgcagtggcaggatcttggctcactgcaccctccacctcccgggttcaagtgattctcctacctcaacctcccgagtagctgggaccacaggtgtgtgctaccacgcccggcgaattttttatatttttaatagagatgggatttcaccgtgttagccagcatggtcttgatatcctgaccttgtgatccgcccacctcggcctcccagagtgctgggattacaggtgtgagccactgtgccgggcccctatcctctctactttctttgttttacatctatttatccgcttaagccaccactctccaatatggcagctgctagccatgcgtggctatggattacttgaaatgtggctactgccagtgaggaactgaattttctactttatttcatcacaattaatttaaattacaaattttaaatcaaagcaatataatatatgtttctgttaaacacagctttattgctttgataggactacattttactttaacaattgaaaatttggcatacaaattgagatgtactgtaagtataaaatatgcactggctttcaaagacttaacacaataaaaagaatgtataatatctcattaataatttttacattgattgcatagtgaaatggtaatattttggacatattgggttgaataaaatatattattaagattattttcacctgtttgtttttactttttaaaatatggctactggaatatttaaaattacacacatggcttgtactgtgtttctactggacatctttggcctagaccatttcagacagcatctccttgagaacagttttcccaatcactcaggctaggcacagtggccttctaacatctttcatgatatgttcttacataggacttattaggctggcgcagaactaattgcagctttctttttttttttttttgagatggagtcttgctctgttgcccaggctggagtgcagtggctcgatctcggctcactgcaagctctgcctcctgggttctcgccattctcctgcctccgcctcccaagtagctgggactacaggcgcctgccaccacacccggctaattttttgtatttttagtagagacggggtttcaccatgttagtccggatggtctgtatctcctgacctcgtgatccacctgcctcggcctccgaaagtgttgggattacaggcatgagccaccgcacccagccataattgtggttttcaccattacttttgaaggtgaaaactgcaattacttttgctccaacctattcatattaattatattctcttcatgaatattattattcatgaatattaattcatattgtcttcgtgtgtctctctccccactaagactataagtttctcaggggcaggaaccatattttatatttccagggcctggcacatggtaggtaccctatccatacttgtgaaattaattaatggatagccacatcaaattcacaagtatctttaaatataatttcacatacaactgctcttttttttttaagatggagtctcactctgtagcccaggctggagtgcagtgacgcaatctcggctcactgcaacctccacttcccgggttcaagcgattctcatgcttcagcctcctgaatagctggaactacaggtgcatgccaggctaatttttgtattttttttttttttagtagagacagggtttcatcatgttggccaggctggtctcgaaacccggacctcaagtggtctgcctgccttggcctctcaaaatgctgggattacaggtgtgagccactgtgcctggccacatataactaattttaggatttgttttctgtcttgcggcttcctggaggtcaagtcttttggctgtgtctctaggccaccacggggtgcagtgaccaacttggggggccatcaggggattccctgtagacaaactgtccagcccttcctagcatcctgttcctagtggggcaccagatgggcacagagcaggagtcagcagttaagggtgagccccagaaggagcagaggaaagaaaacacgaagtgaggagagcaggaagcaagacttctccttcggctttccgtggccctgggagctgagcactgctgccaagcaaacagtggtgtggaggagcgagaaggagagcccaggctggatgtggtcggccgctgggtggagttaaaatgtataacaagggagaggcaactgaagaaaagaaaagattcttttaaaaattctgctctagcctaattaaaaaaaattccactccctcatgctacgttttaagagactgccctttcagaattattttcagtctggtggtaacaggcaggaagagtgtcagatgttcaccaagctataaagaggacactccccaccctctaaaacacagggccagcccccacattgcttttctgacttgggttatgaggatacaggatgtgaagttgtcaaaggcatagatctttccggaaaggagtgtcccatgtggtagattaaaaaaaaaaaaaatggctacagtattttgcagctcctcccaccaagacgtggagtcagtttcaccagcccttgaatctgggttatactactcacgggacatcaggacacctaatgcaagcagaagcttgacaagcacttgcacagaggggtttgctctcttttgctatttttggaatccagccatcatgtgaagaagtctagactggcttactagatcctggagacacatagcctggtcacccttgtggatccctcccaggttccaggcacataagtgataccatctgggaccaccaggcctcagacagtcctcacctgactgtagccacatacacaagttcaggtgaactcaacagaagaacttccaagctaagcccaacccaaactgccagcctccaggatggtgagctaattaacaattgttgttttaagtctctaagttttggatattttaaaaatatggtgctatggtctcaatgtttgagtcacctggaaattaatatgttgaaacctaatccccaatttaggggcattaagaggtagagtctttgggaagtgattaggttatgagggtagagccctcctgaatgggactcatgcccttatagaagaggcctgggggagcttgtttgccccttctgcaatatgaagacccagtaagaagatgccatttatgaggaatgggacttcatgagataccaaatttgccagtacattgatcttggacttctcaggctctaaaactgtgagaaatacatttctattgtttataagttacccagtctgtggtgttttgttatagcagtacagatggactaagacagatggcaaaaccaaccaaccaaccaactaatacagtttgagtcacaggtgggaaaatccatgtagaaataaccactttacaaccttgtataggagagctattataatagtgtgttttggcctgttccggctgccgtaacaaaataccataaactgggtagcttttaagcagcagaaatatatttgtcccagttctggaggctgggaagttcaagatcaaggcactggggacggcagatctgctgtccggtgagggcctgcgttctggttcatagatgatgtctccttgctgtgccttcatgtggtggaaggagcaagctagctctctgggtctcttttataagatcactaattccattcattcatgagagctccacccctatgacctaatcacttcccaaagtccccacctcctgatatcatcacattgaggattaggtttcaacattcagaccataccctagagcgattcagagtgcgggctttggagccaggcaggttcagtcccaccacttagatataatcctggacacgtttgatagcaacggtaacagtgacagtacatgctttgcagggttgtaatgagaactgtgtcggccagggtcacacatctgtattaggataacttgaggagagtttataaagggactattacatctacaaagatgtggtcagggttcagggaaacacaagagagagtgtagcgcactggggttgtgatagcacccaggtgggaagcaaggacagggcatggtgacgagaagctggggacagagcaggtggggtcaagagggttgcttaacaggacccataaccttgtgttgagaaatgagtctgttctgcagtgacatggctgggagggggctgggagaatacaaactctgatctaacttcttcctcttgcctatttttgccagtgatcctcattggccaaacccaactggaagccactgggcttcaaatcagcctcctgtggcaaaaagcaaggtggagaaggtgagagagtagatctggggcaaatggaaggtatccagcccatggatttaaaagcaataatgcataggaaagccctgatcatgtacctagcacccagtcactgtttgctgtaatattattatattatcggaagaaaccaagagctgtgggtggcagaagaggaattgagctgtttttttttttttttttttgctagggtgacctgcagaatactcatggaggaggtctgctttgagttgtggcttggagagatgaagaaaataatagagcaaacattgacatggaacctactatgtgcaggtaccattctggatgtcgtacatacattaatttatttaatcttcatagccactttatggggtaggtactgtgatggttaatactgaatgtcaatttgattggattgaaggatataaaatattgatcctgggtgtgtctgtgagggtgttgcagaaggagattcacatttgagtcaatgggctgggaaaggcagacccacccttaacctgggtgggcaccatctaatcagctgccagtgcagctagaatataagcaggcagaaaaatgtgaagagagagactccctagcctcccagcgtacatctttctcctgtactggatgcttcctgccttcgaacactggactccaaattcttcagttttggaacttggactggctctccttgctcctcagcctgtagatggcctattgtgggaagctgtgatcgtgtgagttaatacttaataaactcccatatatatatatgtgtgtatatatgtatatatatatgcatatatatacacacacacacatatctattccattagttctgtccctctagagaaccctaataccgtaccattattatcccacttcacagatgagaaattgaggcaaagagaagttagataactcagtcaaggtcatacagtaataagaaatggagccaggatttgaaccaatttcaaagagggtgtgggacacagcatttgtttcttaggcacatagctgaaaaatgcacagagaggaagcagtgagtcatccacagggactagtatggggtttgtgctagagaatggggaaagacagagaatggggagagagccaaggaccagaatgatgggtggaggaatttgtcctccattctgggaggctctgggaagccactgaggacttcagagaagagaaaggcaatcacagcggggcaccaggaaatttatccgtgtgcaaggccaaactaacaaagcagggagcaactggaagccaggcaatcagcgagaggatactgcagaggtccaagcactaggtgatgagggcttgaatgaggatgatagcagcctagatggagggaagagacaagggcattgcgctgctaggggaagcacaacaggacttggggactgaagtactggatgtgtcaagcggggactgaagaaacagaaacagatgggaggtttgggagccacgtgataggtgaatgatagtattagatgtatcattcagccacacttagggtacacgttggaaaaaaagtgtacgtcagccagtcttgtgtgttctttggttgcagtgcacatgttaataagttgtaccactcccacacactgcagtcagttgcgaaatagcaatctattttgcaatatcagctcctggtaaatttcacttgtgagcctggaacaaggatgggggtggattcaaggaccgccccctgaggtggtgagaagaccagggattgcaggacattgtgagattctttctggggcagctggaaggatgcttggttgcccagcgacaatcctgcctccgcagcagtcttggtttcctgcagtcccggatgcatctcattaaaaggacagagggatggatggccgacacattttctgaagtggcattttcaacgtcctgagtcctggtatcttgtttataagtggcacttacaaaatacaagggaaagaaaaagaaaacgggagaggaagaaaggtctcctaggatctcaagcatgcagtgcgtggatcttgactctccaatttcagcttgtctaagagacggggtgcagggcctccttgaaatccacctgaaatgaattagcctgaagtaaaagtaggtgtttatctcaagtcattgcctcaaatagctgactacctgttggaagaagggtctgatcgatgcaaaccagagcagtcgtgcgtgagctgttacacagcggttagtatcgatcagagctaaaggctgccgataggaatgtggaggaaactgacaggcagagaagagggaagaaggaaacagccttcgctggtggcagccgtacagaggaaagccgataaaaagtcaattccacttaactgaatggctgctaactaaatatttttggggccagagccttcccaggtagtagctggagcatctctgttccggaactgagacatcaagcgagagccgggcatcgacaggcaagatcactggtccctggtgatggatgggggaagaagagagcccctgaatgcagagatgggaggctttgggctcagccgagctgactggggcacttgaggacagccactgaccacggagcactgctggcaggcaagaaaggaacagggtgcagactggatgttatggaacagttgctgattaattagttcatttaaaaccccgatgctttttcctgaacctcactcagtaagggctgttgaaactaatggctgcagagaaagttggacaatgcctggtcctatcacagacagaagcagaatggtgccatatagtgtagttaagagactggctgatgacttattttcctgaacttttatgccctcggaaggattgtaattctttttcttgaattagatgtgaacatgtaacttgtttggccaatgaaatgtgaatagaagtgatgcatgtccctgctgggtagaagcatttaattactggtgtacaaccttcctgttctttgcttgccactgtgatcctgcatactagtgttgatatggataagagtgaaactatctggaatgttaagcaaatggatgcatagttttccaaaactgcaatgaattttgtgtgaataaggaataaacttctattgtgtcacatcacttaatttttggccttgtttgttacccagcataactgaactttttctgactgatacaggggggctgggttttagaatcctgtctctaccagttgttactatttgggtgatttggtctatttcttaatccacccaaatcttgttttatttatatacagcacatgaaaacagcaacaacaacaaattaccatgtgctgaatgttcacaggtgcaggcacggcaaaagctctgcatatattaacttgattaattctcaaagcaaccatgtgaagaaactattcttgtcttaattttacaatcatgaaacctagtgctcagagaggttgaaagaattccccatggtcacacagcttataaatgacaggcaggaatgcaaacccaggcagaccaactccagagcactttttcttaaccattttcctatactggctctcagcttgggtacttaataaataacaggtactataagcccaggaacaaatgacactgactgacccatactcaagcactctatatggaaggagaagaagaaaaggttgcatttcttttgatcttttaccattttatactccctattctcttacaagcctctgtagagtttgatcctgtctgaaacatccttctccgcttgttccccaaatcctggttgtttctgaaagtccagatcaattccccactcatttgtgatacaaacaagggaattccttagcattagaagagaccatcagagaataccttttggaagagtttctcatctatataacggggatggtaacactcacctcatgtggttgttggagtaatggtcatgttttatcaattgaaccccaaagagatcctggggagaaaggggcattacactgagcaagtgcctacttactttgtgctaagtctctccttaaaccttccccacactcttccaaaggggataacactgaccccagatgaccggtggagaaactgagccttaaagagttgaagtgggcctggtgcggaggggcacacctgtaattccagcactttgggaggctgaagtgggcagatcacttgaggtcgggagtttctaagaccagcctggccaacacggcgaaatcccgtctctactaaaaatacaaaaattagccaggcgtggtggtgggttcctgtaatcccagctactcaggaggctgaggcatgagaatcgcttgagcctgggaggtggaggttgcagtgagccaaaattgcaccactgcactccagcctgggtggcagagactctgacacacacacacacacacacacacacacacacacagaattgaagtgatatctagtgtcagtctctattttctctgagcccatgagaccatttcacaattttgaggtgtaacagccttctatgtaccttaattaggagatcgtctttgccctctgcttgtcaaatgctggttgcttgagaaatgcattccgtttactgatatatcaacgtattgaggtgtagtgtgtgcgtgtgtgtgcatgcagatgtgtgcgtgtgtgcgtgtgcgtgtgtgcatgtatgtgtgcccacgcctgtgtgcatgtgtgcgcgcatgtgcatgtgtgtgcatgtgtatgtgtgtgtgtgtgtgtgtgtgtgtatgcccactcgccaatgtctgtgctcatgctcctttcaaccgatattttgggtatgggctaaggagagtgtgctcaggctattttaagttttgtacttaacgcttagcaattttaataaacttcattcctttaggtagtcgacttaatattttaaatatggttttaattaaccatcctccttgtgtttaaggcaaaagcaggaaaacagggaaagcgtctaacccgagagcattgccagtgattccactctttgtgacaatgaaggccagaattccagaatgcagaggcgaaagctctcccaaaattgtttcttagggcatggacctataatacttaaatcatttctaattccactgggttctgttatcccagcacagactgtaaacatttatttttgggctttcccagaaatgtgtcttatggaagggattagctgtttgcgcatgtaaagttccgaaggtgagctcctctaacctaacccacgtaattaaagtggaaaatttttggtggagggaaaaaaaaaaacatcagggaaaataccatgtttggaaagagagctgtactccgacagtctcaagagatggctctgcgttcttgggcacttaattatatcccatcttgctgtgtgctccaatgctttcatccttttggtctttacagacaataccaggatccctggcaccatacactcttctccgagagggtctacaatgtctagctttgcactgaggcagtaggcaacttgaggacaaggagagtgacactggcgtggagccagagactgggtttgccctatcattttaaaacatgatgttcattactttttaaagtgtggagtatatagggaagaaaataacaacaaaacaaaacaatagtttgtttttaagatggagtcttgctctgtctctgaggctggagtgcaatggaggtgatctcagctcacggcaacctccgctgcccgggttcaagggattctcctgcctcaacctcccaagtagctgggattacaggcacctgccaccaagcctggctaatttttgtatttttagtagagacagggtttcgccatgttggccaggctggtctcgaactcctgacctcaggtgatccacctgcctcggcctcccaaagtgctgggatcacaggggtgagccaacacgctgggcccagacagtcttattttaaaatgcaaatggctaggggcactataagacatttgtcaccaacctctatgcaactgccgctttgtgcctgagctggtggcgctggttctggagttagaccccctgggctccaatccaggtcctgtcccttgctggctcttgttaacttctttgtgtctcagcttctctatctgtaaagtgggagtaataataggacttgttttctagggttgacatgagaattcaatgaaagaacatatgaaaataccatgagcacaagtcaacgcacagcattacatagcaggacctgcaaaaggtcagctactatgcctgttatatataatgaatgcctaaatataaatcatttaaaaaaaacaactgcctttgtgaagtacttaataaacgcaattcatggtccagagtgctttatgtacatgactcatacaatctttcattcaaccctatggaagtaggttctagtaagaatccatttcacagaggaggaaatgaaaaagcaaaatgtaacttgtccaaggtcattcagctagctcaagctgggctttgagggcacgtctgattcttcctactggaccagctaagtcagacagggtacttttaagaggggaacacagagagacagagagactttaggacccagagatactagtcaaagtgtgagctgacacagtgagcctcacagggtgggagggatatccagaggagagggcgaaagcatcaaaggagctttgcctttacctgattttgcctggggccagtacaagatctgatttcttttgtggtctccaatgttgcctgcagcagggagttacgaaaagccactggatccgagtcctaaaactaggtactgtattccagttctaccacacattctatgatctcggcaactcacattcctttcccagcaagttgcattttctgggaaatggggatcaaaaatcttggctcacctacctcctggagctgttgtgaggctcacatgtttggggatgtttaactgctcggttaactagaaagcactgcacagagatgctaggtattattattggcttgatgcctccctgtgatgcaagagggatgagggtccggtgcagtggctcacacctgtaatcccagtgctttaggagaccgaggtgggaagattgcttgaggccaggagttcaagaccagcctgggcaacatagtgaaaccccatctctacaaaaatttaaaaattagccccatgaggtggcacacaactgtagtcccagctactccggaggctgatgtcagaggatcacttgagcccaggagaatgaagctacagtgagctttgattgtatcactgcactctagcctgggtgacagagcaagactctgtctcaaaaaaaagagtggagaggggatgcacttggtcctttaaaactttgatttagagaggacccaaacttgtgcctccctggagaaaactttatggtgtcagagatcctgggattgtctggaatcaattcaagaagagggaaggagactgggagcctcgtggatgaaggtattatgatagcaggtttcaggaacacgccgtaatcagctctctcttctctgtagttccactcctagcaatttggggccagctggggactggatgatgtcctctctgatgcattggaatttgtcctgcttcatggtctggtctgctataggaccacatatcacacagagacacaaagcaattgacagcatcccggccgtttcttacagatcccatatcctgtgtctaggctgtatttcaggccaacttttagtgaagtggatcaatgcttgaagcacataatgtaacatgattcttcaagggtttgattaatcgtgtcacagtcacagcctcagttcaggttcaaccttttaaaagttttattattgtataaagtgatcaatcaggaggagagggaagacaaatgctcgatgttggccatctctccctctcgtcttcgtcagcaagtgttcttctcctggtcggtttggccgatcgtgatggagaaattcatgaagatgcatggcacagcaaaatatggatcaccaaagagtgctctgagtggaaggccagctgctccagtgatgagcaaccttggcaacacatgggaggcccctggggtgttttaagaagttcagagccctgtatttcacccacagaagttctgatgcttttggtctagggcatggtctgggcatctcttgggaattctaatgtgtaactgagtgttacggtggaattatgtccataacccccagtatcccagaatgtgactgtatttagagataagacctttaaagaggtaattcggggctgggcgtggtggcttacgccagtaatcccagcactttgggaggctgaggtgggtggatcacctgaagtcaggagttcaagaccagcctggccaacatggtgaaaccccgtctctactaaaaatacaaaaattagccaggtgtggtggcgagtgcctgtagtcccagctactcgggaggctgaggcgggagaattacttgagactctgtctcaaaaaaaaaagaggtcattagggtaaattgagggcatatgggtggaccctaatccaataagactggtgtccttttaagaagaggagattcggacacagacacatagagcaaagaccatgtgaacactctggaggaagatggccagctataagccaagacgagaggcctcagaagaaaccagtcctgccaacaccttgatcttgggcttctggcctgcagaattatgagaaaataaatttctgtcattgaagccacctaatttgtggtactttctttgtggtattttgggggttcctgtccaccaatttctgttttctccatctccagatccctttcttgggacataccctgttagaagctgctctcacagtaatccccaagaaagtattagctgaacttaatgttttagccctcccacaagtgcctgcattttaatatgggattcgtacctggagtaatctaggtagctgagatgcatttggactgatggctttccagtcataattgctgtagtgatagccgatacttattatgtgccaaatactgttccaagtgctctgtgtctatctatatctatgtctacgcctatatctaatattcattcgttgaatccccccagtagccctatgaggtaggtgtgcttaaaagaggaagctgaggcacaaaagggttgagtaatgtatccaaggtctcacagatagtaaatggtagagctacgatttgaacccagcaagtctgacttcaggtaccatgcttttaaccactcacaactcagatgacctcaatggcccctagcaggatcggaacagactttgaggactagctttgtttttctaacaatagctgttagtgaccttccgtgttagtctccccacctcttttttttttttttttttttttttttttttaagagacagtcttcctctgtcgcccaggctggcatgcagtggcgttatcacggctcagtcctggtctcaagtgatccttctgcctcagcctccctaacagttgcgaccacaggcacgtgtcaccacacccagctaactaaacatttttttttttttagatatggggccttgctgtattgcccaggctggtcttgaacacctgggctcaagtgatcctcctgcctcaggctcccaaagtgctgggattacaggtatgccccactgcacctggctccctgttagttcttatttctctatttctaagtccctgagacagtacccactgtgggagatttttttttaattgtttccaaatattacccttccttatgggaggattatccttctcccatctcatcaacatcagacttggccatgtgacttgctttggctgccaataaaatgtaagaggaggtgatgtttgctacttttgagcagaaattttagaagtcatcatgtgattttttctcttctcccttctagcatgagaatgctttgaagtcaggcccaagcagcaacttcagctcaggtctcagaataaagacaaaatagagaggagatgcaatcaacctgtgttgattgaacaaaaatgtatctttgttgcaaaccactgagactcaggggttttttgttactgcatcattacttagtaaaaacagactgatacactctctgaataccaatatatttaagtgaaatgccaggactgttgtaaggataatatctttaatcaataagcatactcttaaataaccaataaactgtattatagcttatccaagaaatcttgcaatagagctttctgccctctgtgaatactttctatgcatctatccatctccatctcagaaggctaaaagatcataaacccttgcctagctcagtacacaccgagttcattcaccagctcaatatgtacaaagagaatcagaaagaacagatggagcagactaaatgttattttaggttccaggacattggatagaatgggagagaaaaaggatttattttctttcgtggatgggaattagtacaaaggcctgatgagactgtcccttatccaaggacagagaataaaagaactcttcaatgtaaattatccattccaagctttcgaccctgctgccatttttagttccgaatcgctcacttctctgagaggttgcaaacttatgacctatgaactgaatgtggcctgtggaagtcttttcacataccaaagaaaacactattctatgtgcggatgttcgaatcaaattgattgccaacaatcaaaatttgagatatttcaggttaaaaaaaatagttccagcttctcttaattgaaagccttggttacactgggcttaggaaacttcaactaaagttgagtagcagctgccttttaggctgggcatggtttccacggtccctacctctccctattgccttatactaggctcacttcacttatttatattcttttttttttttttgagacagaatctcgctttgtcgcccaggctggagtacagtggtgcgatctcggctcactgcaacctccacctcctgggttcaagcaattcccctgcctcagcctcctgagtagctgggattacaggcacacgccaccatgcccagctaatttttgtatttttagtagagacggggtttaaccatgttggtcaggatggtctcgaaatcctgaacttgtgatccgccctcctcggcctcctaaagtgctgggattacaggcgtgattatttgtattatttgcataatccatggagccacttgagtttgccaccttgagtatcaattaactcctttcctttcctttttcttgtccttcttttattcctatgtcttccacagtaaacaaggagatcttggggactccatttttgccactctgaggacatcactcttctgccttgtttttggaatttggggtgacccaaacttgacagtccagttctttggttcccaaagagcttcattctaaactatctattaggttggtgcaaaagtcattgcagtttttgccattaaaagtaatggccaacgggagcggtggctcatgcctgtaatcccaacactctgggaggccaaagcagacagatcacttgaggtcaggagttcgagaccagcctggcaaacatggtgaaacctcgtctctactaaaaacaccaaaaattagtcaggcatggtggtgcatgcctgtagtcccagctacttgggaggctgaggtgggaggatcacttgaacccaggaggcagaggttgcagtgagctgagactgcaccaactgccctacacgctgggtgacagagcaagactctgcctcaaaaaaaaaaaaaaaaaaaaaaaaagtaatggccaaaactgcaatgacttttgcaccaatcaaataagacaattctaggggtgcagggaagaaatgctttctgctggagattctgacaatgtttatctaacagcttctacaatacttggtgatttgcatacttgtgtagctagcaggtcttggagcagcataagcctcctgcctactagataattctgttgcttaacaaaccataacagctttgattacatggaaaatgctagcagtaaatgattggaaaatgattttactgttttctgttatggaaactcacatgtaggaacattatggaactgtcttgaaatttcttttgccttctaaatataaaatcactagactttgatatttcagcaattctacattttaaaatatcagagctgatgagatcgatactgctttgtagatacctacactgcagagagctagccagtgctatctggataaagtagacagtaggtaggcatttgcaagcctctctcacctacccctttctttttctgcaccagattcattgctatactgacctctcattgactgaaactttacatcaaggctcagggactgtaaacccaccgcagcttggaatatggaatatggatgttgagatacacacttcagttcctgaactcagtaatgaaatcgcccccagagttctcatgccagcattcagctagctgcaactttctcctgcttgccttctaaggagattaagaacgggcattttattttgtttccgttttagtttatttgaaggttttatgatgtcttggttgagtggctcgtgggacttgcaaataaacatgctgcctttaaaaatggcaagttgtttttatttatttcttttaggtgcccagtgacctccgggtatattaggcagctttaaattataattaaaataataactgtggtcctaaaacagtaatagatgttgaatgatacaaacaccaaattaggatgttcagaaaatctgtatgaaggaagccagagaaagcatggaattaaaaaaattatctttgtggcaggaccaaaggaaacttatctcaaacagcagctttgttataatgcttttgttttgttttgccttcctataaggctactcaaaattttttttgtatttgctagatttggggtattggggggtgggggaatatccagttctttagttgatcttgctatgactttgccgacagaaggaaataatgaaaattgcttgtcatcggagaaaatccctgtattctaatgatttcttgacaacttctgaagtccatgggcacaatcagtagaagccgacattgtgtttcactggatgccaaatcctcagagtgcttctgagtccctctaagacatacatctgcattcctccatctgtcatcttagttcatcttcctctcccaactgttcttaaattaaatgactacatctaatgggagattttctcgtgaaagcttatgagagtttgtctgaagacaaattaaaacattgcaatgtaatcacccagctccactctctgcttggctggccccagtgcctacttttacccaaagaagttaatcaacgtttgggccctgtatagagaaaagcaacaaggaaggaaatccattcaagaggagatggaatctacccgctgacggtcagagggtcaggggatgaagactggatctgtccgctgcagagagagctgtgagatatgccagggctctgaagaccagggcaagaagagtaggaggcagggagtgaaagaaaacaaacatctggttccagaatatcaaggcatgatgcttaaccccagggatataaaaattccccttctcttaccctccactccccatggatgagtggatgtcttcctgcagttgttacaggtcactagggttgatgggactcttcagcttggctagttattgccccctacttctttttttgagatagggtctcacttttgagatagggtctcactctgtcacccaggctggagtgcagtggcatgatcatggctcactgcagcctggactgcccaggctcaagtgatcctcccacctcagcctcccgagtagctgggaccacaggcacgcaccactatgcctggcttatttttgaaaactctttagtagagacagagtctcactgtgttgcccagcccggtctcaaactcctaggcttacgcaatcctcctgcctcggcctcccaaagggctgggattactggtgtgagccactgtgccctgcctggtcattgcccttttattctctcactgcaccatgtgaatccctttcaacatttggttgaaggggacagcatctccagcaattccgccttacagaaatttatcctaatgagacgagacagattcactaagcacaaagatgtccatcatttcattgtttacaacatcactgctcattaatagggaattagttaaataaacaatggtatatccaacactggaatgcaatgcagtcattgcaatgaaactatgaaaaatcatcaaaaattattgaaaatgtataacccactgacatggtatattgttgcagacagtatacatactatgataccactggcacgaaataaaacatatgtatatgtgcatgcataggagatatctgataggacgaagtccaggttaaccgtgtttacttctgggtggtggaatttttggcgattttaatttttatgctttgataaattgcttgcatttctcaagatattgtacattatcttttaatcagaaaaataaagcttaaagctaggtctatatttgagagaaaaaaagaacagccttggttaatggtatgtgagtcattacgctgttctcctaaagtctccaaacccaaaaatttcccaaggcattgaatcctgggaaagagctttggctgggtcatgatgggaacagggagttggctgccgccgtgatgctccaactctttattcccaggctacaacagtctaatttgataatcttttccattgaatctttatgctccctactaaacactcagagtgcttccttggatcaatgctttcaagttcatcctcatatcatctttgtaaggcagaggtaggtagggaatatgaagaaaagtttcaggacctgagacatcagtggctatgggacttgagggagaccatggtactgctgagactagcgtactggttctcaatctctcagctcagtgcttcttccacaaacccctagtgcttcactttcagaagtgagatggagccaggcatggtggctcacacctgtaatcccagcgccttgggaggccacggtgggagaatcgttgaggccacgagtttgagaccagcttgggcaacatagtgagaccttatctctacaaataatttgaaaattagctgggcatggtgggcacgtgcctgtattcccagctacttgggaggccgagttgggaaggattgcttaagtttgaggctgcagtgagctatgatcatgtcactacactccatcctgggagacagagtgaaaccctgtctcaaaaaaaaggtataaaataaaatgacctttttaataattcagtaaacgaaactaaaaccatccgtatcttgtgtagggatgttcaagagttggattataatctggctgtgatcaaagtgctcattaagaggaatatttttggacctctaatggctatcattggacctgattcatcctgatctgctgagacagtgctctcagggaagtctggagttcgggttaaaggtttcagttctactattaacagtggcaaacaaaggcaagggttaacctgactaggtctcaaccttttcatacctgaaacaaatggggaggccgggcgtggcggctcacacttgtaatcccagcactttgggaggccgaggtgggtggatcacttgaggtcaggagttcaagaccagcctggccaacatggcgtaaccctgtctactaaaaatacaaaaattatccagacgtggtggcaagtgcctatagtcccagctacttgggaggctgaggcaggagaatcaattgaacccgggaggtggaggttgcagtgagctgattgtgccactgcactccagcctgggtgacacagtaagactctgtcccaaaaacaacaaacaaacaagcaaaaaaacacgaatggggagagaaaccttggctttacactccccaaggcatcatttggaggatcaagtgatggaagagataagaagcccctctctttgacttctctctagccttctcaagagcagctggtcaccccaccccatagcataatcttgtaatatgctgccacttacactctacatcttgaggtttctgcctccccagtcgggctgtgaaagaacaaagtcaagaatgattctgattcaatataataccacgcctatgacctaatactgtagttttcaatagatgtttgccgactgggtgaatggttcagaaattcaaagtactccaccagtgaaataccttagagattgtatcagtgggaactcatggaactgtcttactctgaaatatacaatgtattacccatttaaaaaagctcacacgctttctgagattgttagagtatttggaatgacaaaagtagttgctgatatttgactgatcactttgtgccaagcactgtgctaatctctttaaataatttttttttttttttcagagacggggttttgctctgtcacccaggctggagtgcagtggctcgatcatagtttattatagcctcgaactcctgggctcaagggatactcccatctcagtctcccgagtagcagggactacagctgtgctccaccgtgtagggctaatttctaaattttttgttgagacagggtcttgctgtgttacccaggctggtctcaaactcctgggctcaagcgatcctcctgcctctgcctcccaaagcgttgggattacagacataaggcatcacatcatgctcagctaaataaattttctcatttaatcctaccaccctccctttgaggtaggtggcattatcattccagtttttcagattctgactctgaggctcaggaggtagtctgcccatgcagagaaagaataggtctggaagccactgcccagcctgtaatcttgatctctttcctgactgtgtgtctggagcagatttgcaacaaagagcagggtggtttaggacctgtttattttcattctaactcagggtttatactgagttggcttcttgcagatgctctttcaaccagcccctgttgagcaggtaaaactgaacaaggctgcgatgaaggctctgatgggctgcacatcatcaccctgccatctgacaatatcattcacctccagagcattagctcaaacatggtccctccctttgtttcttaaatgttcccattttcttttacttccccctctgtttcctcttaaccagctgagtgacagaaactcaatgctgaccacttcattagcccatgatgaccttgtgcctctggccttttgccctgcctgctctcctgggcaggttgccttacgtcataagtccttgttaaaggtcaggacctctgagccatcagcactgggcatgttgttttaatatatatctagagaaatcagggctgtcggatcacattaggtcctatttgcagactgcatgccaatacccgccgtagagaagaactgttacctttgaaatacaatcatggctagttaccagtgagtacagaggggggattatattccatcagtgaggcccttgtaatctgtttctccccccatcggcagggccacccttcttcctgtacagagaaaatccttataaacagtagtcacataaagcagtgaggctaagagatacattgtgtttttaaaaccagatgcgttaatgagtgcatgacgggtagtgtggaatgtgataagtcaatgccgcaggcgctggtgtgaattggcacaatgctctggggctagatgttgatatggtaataaaatgataaagttaacagctactattcattgaatgattataggcacaagactaagcattttatatgcactaccctgtttgagagtcataatatccttataggtcagatactactatgtccatttcatggatggagaaactgacgtccagaaaggcccagtgattggtccatattaacaaggccattaagtgatggggatgaaacggactccaaagctgctcctaatccccaggcttccatgattctgccaggatacaatttggtctcttctttcaggtggagttttaggtggtgcttaagtagaaccatattgccatttcccttctagggaggggcctcaaatatgtcacttgacccaacagattttttttttttaactgagtctgagaataagccaaccttgtttcccccctttcttctctaggattggtttaagctcattctcacatctcatgggagtctggttggacggatcccttgacggaggttagaaatagctctcatagcctatttttaaggaaagcatgacgttagaaaatgaggcagaaatggaccccgagaagagaagagaactcaccaggctagagaatagggtcaacttctaacgaagccttcaccaagaaatgctcagagacgagaagtgggaagattgacaaagataacattggcagagacatagtagggtgggtgaaattgcttttttcttcttccttcacccggacagcatatttctgtcacattcattgtgttttgcccacagaaagctcagccaggaaaggtaaatgctgttgtcttgcagcaaacccacttttctaactagagaaatacggcccgaaaaatgcacacagaaatgcctgcttatctctttcttgaaaccccaggcacactgcagaggtgtctagtaacactgcaatttcctttgaactgtttggttttgtttggtgtccttgtctggctggttagtcttttttgactgcgttaactcacctggtataacattttctttcattgagaaacaagaaagctggaactcacctctctaattccggcaaagctggacaccatccaatagcgctaggctagacttctgggggttgtaacttatatcttccgagctgaagaagaaaagaaaggacaaaaacacggttggggagatgtttggcaaaccttcgcaggccaagtggctaatgaatgattctcccattgcttttcacttatttttcttaaataagatttctttctagggtgagggtttattcaagtcacccccttgtcggccagtatcaaggcaaatgacacagttccctgtattcacttatgtttcctaggctatagaaaagcacattcttgaactgggaaaggcatttttaaaaatgaaactcagggcagccaacctcaagacagcatctgatattaattaaaaatcataaaacactctaagtcgaactaaagaaatattggtagcgggatcaggacaaggatgagggaaattgaaagtgaaatcttgtactcatggaattctcctggccaccgcatttctccccgtctatcccagggaaaggattcaaatggtgttaactactgaacacttgcctcgttttccattcctctttccctgggtagctgcggtgagttggctgccgagatgtagccctgaacctatccatcaagtctaaggaagagagagttagaaaggcaaacattatctggaatcaatatctttacaaatccaaaggaaaccccagctcccgaagggttaagccagggaaggaaaagccatcaggctgtttagtgagctaatgtttttattgatgggggaagcctttaagtccctaacaggaaaagtggggaaagtggcagattgtttggctggggagaaaggagacgggaaggaacattatacaccacgctgtgtcctactccacgtattcagacccctgaaacccaacgaatgcagaagacattccctaaccttgaataatattcaacccaaggtgttttcctctctcctacccgcccctccccgcaaagtggaatccacatcttcccctaacaacttggctataatgcacatctcttggctaatgcctgcactgaagagcatatcttaattgaacaactgtgttataaagcacatctcaagctgacattcctgggataatccatatttcaacctaactaccctggcataacacttcaatctaattcccccactgtaaagtacattgcaatctaacaccctcatataatgtacatttcagtccattattttgtattttgtaagccatattttgacacgtcttttccattaaggagcagaactgtctggtgacaacggctatccctgtgctgaaagcccccatggtttgtacatcgtcctgtggtgacaggctgctgatggacacgcttctgaactttcacctttgccatcttaggttcaactcgggcttgtttctgtacttcaagctcaagcctcctgttgggggagcaggggtgaccagagagccctgctcggtcctggccagctttctctcaagctgaccagcaggtcgggccacctcacatgatcaaagtcaggggtcagggtgtagccaatgtcagggtccaatgccaggggccaatgtcagggtcagaggtcagggtgtagctgctggctaatagagtgtcagctaacactgttgtcaaattgctgggctaaaagacaatggcagcctcctgcggaggaccttaccctggggggagggggcgattggctttattggaaacctgccagtctcagaggtgatggaagtggctgatcacagctaaagactgtttgattgttgatggagagccagttctgtggttggtccctaactgaaaggcctgcagagccgcttattgatgactgagttttccacttatgatggatttctcttctgtttcacatgcagctggatttccattcagtcatggaggtggattgcggtgacgcatggccacagacttttctggaactgagagctatgagaggtgataccgtcactgacttctgggaaggcaccaacctcgtattgtctgttgaatggggctgattggttcttgaaatgaaaccaatccagaatgaattgaaaaatagatataagaggtcctgcaagtccaagacagttcagcgaacataaaaagaaggcaatcaatgtgttctggaagagatttagtattctaactatcaatagcccagcctcaaattttccacctatctcaggcaggggaaagaaattagatttctttatctactggtggcatataaccaggctagtagtgccattaaatatttgatgaaaacgaggttacaaaactggaagaattccaaaatttcccaagatagtatgaatttaagagagacaaaaacaggaggaggaaaacaaagtatagagataaaaaatgatctgggccgggtgcggtgactcacgcctagaatcccagcactttgggaggctgagatgggcggatcacaaggtcaagagattgagatcatcctggccaacatggtgaaaccccgtctctactaaaaatacaaaaattaactgggcgtggtggcacatgcttgtagccacagctacttgggaggctgaggcaggaaaatcgcttcaacccgggaggcggaggttgcagtgagccgagatcgagccactgcactccagcctggtgacacagcgagactccatctcaaaagaaaaaaaaaaaagatcttctgaaaggcatacggaccatggaggatcagctaatacaaacccccaatgcagcctctgctaagacagacaataaacaactagaaagcatgaatgggagaacggcttgttgaaattgcaaggttattctcctcttgagttatgccttgagaaaaccatatgaacatggcagtactagttttttaaactcttttctttctttttattttttaattaattattattattattttttgagacagtgttttgctctgttgccaggctggagtgcagtgccacaatcctgcaaacttgacctcccaggctcaagcaatcctctcatctcagcctcccaaatagctgggactacaggcgccaccaccaagcccagctaatgtttttgtattttttgtagatgtggaatttcgccatgttgcccaggctggtctcgaactcctgggctcaagccatccacctgccttggccttccaaaagtgctagaattacagacgtgagccaccgtgcctggctggtagtactagttcttaagcctcttattaatagaagtagtaaaacatcctagggagaaaagtgaggttgggaaatgaactggaattgtttttcttggaaaagaacaggttaaaggtgacatcaatgaccttccactgtattccattgtaggataagccatgttgctttggccatgccaatatggtatgatggcatatggggagacgttggcatgactcgaggtactacttctacctctttaagcctgttttcttcattgttaaaggggatcatgccatccacccaacacaggtacaacggggatgaatttggatgtagaactgttagactgttagacaaattcaaccttcaaaacacagcagtttccttttgccttaaaccacagcctgaagcccgagcaacgtagccagactgcgtctctactgaaaaataaaaataagaataaaaaaattgggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccaccgcactccagcctgggcgacagagcgagactccgtctcaaaaaaaaaaaaaaaaaaaaaaaaaaaaattagccaggcatgatggtgtgtgcctgtagtcccagctattccggaggccgaggtgggcaaaccacttaagcccccaggagttccaggctgcagtgagccgtgatcatgccactgcactccagcctcggtgacagagcgagatcctctcccaaaaacaaaaataaaaaaacccatagcccgggcttttccatgatggacattgttaaatatgaggtgttggataatatatcttctctttgtgagcaagaaagtccagtatctatttagaaagtttaggcaaactctacttgaccacagggagctgacttagcccagagcttagcaagctatggctggcaggctaaattttgcccatggcccactattgtaaataaagttttattggaacgcagccacactcattcatttatgtattgtctatgattctttctgcaccacgacagcagagttgacttgttatgacagagacagcatggcttgtgaagcctaacatatttaccatttggccctttatagtaaacgtttgccagccctgacctacaacaatggaacactctttcctttgtttaaaactaaaatcttatgtggaaattcaatatgcaaagcaggttcaagaaacaaatatttccccaggaagctgaactcttccttgtttggcagaaataatctatggttggtagaaattctacagcaatttccatggttccatgcagcaatttgaaaactatgaactggataatctctggatacttctttaaggtcctagaaactcagtaatttcttcagagattaaagaatggccgcaaatgcgccttcgtctggcaaatgctgggctttttttttttttttttttttttttttttactattatctgtgtgatgttgggagggttactgaacttctctgtgcttccatttcctcattttaaaaataaagaaagttgggttgggcatggtggctcacgtctataatctcagcacttcaggaggctgaggcaggcagatcgcctgaggtcaggagttcaagatcagcctggccaacatggagaaaccctgtttctaataaaaatacaaaaattagtcaggtgtggtgccatgagcctgtagtcccagctactcaggaggctgaggcagtagaaccatttgaacctgggaggtggaggctgcagtgagcctagatggtaccgctgcactccagcctaggcgacagagcaagactccatctcaaaacaaaacaagaggatgattgtatttgcttcacaatttgttgtaagaattaaatgagattatatatatattttatatatatataaagtgctatatatataaatagagcacttaaaatagggcctggctcatagtgctcagtaaatgtcagcaattattgttgatattttatataattacattaatattatagactattatcaacagatattatactttattaataaatgccaatatattttactttatattatattttatcctattaattatattcatattgtcattactatattttatattatattataatattattttatattgacattacataatattatcagcagatattatactttattaatattaatgtcattaatataatattttgttatattaataaaaattattgttattaacatgtggggccttcattcatgctgtagagatcacttccatattattctaaatatccctaatgacatttccgcttattagttaattaattcagttggccactcactccacacatctgttgtgtgccaaagtaatcaggaaatgaaccaaagtccatgcgctaccagctgcacatctagtcctctcttgctcagtcattttcggcactttgcgttggtgtttattgctctacatcttctgcggcgtttcagagtgacaccactgctcaaaacaacttcctactactccgtctctgactgctccacaattaatttttcaactagcagtttggtttcaatgcttacaaagtaattagaccttaaaggctctttacctggattttatcctgtcagcgaatgtgaaagaaacaataattattatttaatatttattgtcttcattgtgctatgtagactcacagatgtaacctgccttattgttgaagatgacagcagagtgcaggcaggtgtgtctggagaagtagtcagaccgctttggaggcccaagttctcagatgcttccatctgacacctgcgcagtcaaaggacacattttgggttgagtggttcctaatttgttatccctaagttttcattttctacagtttgattccagaatggtcgtttccaaagatgacattcaatgatttcttgtaccaagcagacggagcttttgggggagttacattttccaccactgtcaacagaagagtagaacagacacaaccgcagatgctgctggatggaggctccaggcccctttggattcactcttcccccaccacagactggttcaggttgtccagaccaaggtgcataggggctggccagagtggtaggtggacaatgtcatctactggctgctaagaatgttatccctgtagtttggggctggtgtggctcagtaatcaaatgtgtgagcttctttgaagtaagatggccctgggttcaagtcctgctcctgccccttcccagcagatgacctttgccaagttacttcccactgtcagcctcagtgtgtcctcatcaataaatgaaagtaacaataactacctcacacattgttttgcatatcaaataaaataaatacacagcaagtggcagctgttgtaattatattattataatagaaaagaaatagaacccatagtttctgttttggagtgccttagaagataacaggatataaacataaaagcatgaaatcaccttgaaaaacatttacacgtcttcatctatataatgtaaactaaaagagtagttaaaagccaggggtatcagagtgactggtggacatgatttgctctcatgatttggtgtaaataaattgcaaactcccggatgacagagcctgtatacatctttgtatctccagcactttctagcaaagaatcttgtacattttaacccttaacatgtgtctgttgaactaagttgaactggatttctttgtaaattcagtagaattctaccaaaaataatcactggcacaactcaagtgtgcgcgcagataagaaacatgaatacagtgttgaaaccggcatcactcaaacaaaaacaaaacaggaagtcttacacagaatgggcaatattatttggcaataaaaaggaataaatgaatgctaccatgtagaagaaccttgaaatcatgctaaatgaaagaagccagtcacaaaaaaccacacactgaatgattctatttatatcaaatgtccacaacacaaaaattcatagagacagaaaatagatgagtgattgctaagggcgaccaaatccccaacttttttgcatatctgtattgtatataatttctataatgaatttatattactttggaaggaggtaaatgttattaaaataaaacgtacaacacaaaaagtggtgagggacatggagggaaggggagacttggttactgaggtcaggcatctcagaggggaaaggaaggtgtgtgggggttggagaaggcttcctcgttgggaaaggaatgttgcatgtagagaacagcattctgtagcaggaatgaaagggggaaccagtcagaggcaggttggaggaaggccttgaggaactgtgagaaggatctgggtctgatatcaggatacagaggctgcctcctgctcggtgggaaagaatgtcgtgattgattggtgatacctgcccgggcataggaatggcagtgatgaatcaatgccacacactttctactcctccaggagccttcattctgcaggtgcccgagaaataaaaacacatttaggtctgtcctacgtgttgaggtctgacgaagtagagttggagatctaatctgaattcctctaaattcccatgaaaatattccaatctccatgggttccttgagtcaaattcaggaagaattcacgtgataacactgaccttgccgggggctacacaaagaaaagtgaactttctatttccagcattatatcagttaaaagaagaatgcaaaaaacaaaaaaaaaaaaaaagagagaaagaaagaaaagacccacccccaccccacccacacagaaaaaaacagaaaaggagaggggcggagaagagagctgggaagggggtttggaacctctgggccctatcagttactgagaagccactctgtggaggagacacgcaagcttccatccctaagacatttccctcactccaacaagatattttcagtacatcccaggcaccaaataactgctcatatgtcccgaacgatgatgaattcattcaaacaacaagtcaagaccctggatatcactcaactccagtcagtcataacagctgacaaataaaaaatataatatacagcctgttagttctgcttttcctcatcttcaatatgcagattcaagaatcgcattctattcccagctgtcagagacggtgacagttgtggggagttttctagctttatcaaggaagattatttttaacccaaattattttccattgtcaatgtttaaatccatattaagtccagattaatgcaggaagtagcttcaaaggatattgactgagggagaaataataataaatgaaattattaaggacagggcccatttcaaggaacattttcagagtagaaaagaaagttgtttagatttaaatgataactaaagaaaatatgtttcttagggattgctggctcttttcacaaacacccaaactttgtatacaaactaggggcctgtagcatttttctttctttttttttttctcacgtgattggaattaataatgcagataaatcctaaataaatcaggattagtgttaaccacatcttgaggtttaggatgctataggaaaatgaaaagagagagagagaaaaaaaatgagttgcttaaaaaaaaaaaaaaaagccctggcctgggctaccggggtgaggaggggagagaagggggctggggggaagggaggggagtaatcgcgagaagagagggccagctgagccgggtaatcaaagcccttctaatcgctgcagctctggagatgtgttcaaaggctctttcctgaccacaggctgagccgggtcacaagtgaaatgcagttgctgtgaagggggaggggtgtctggaatttttggatggttttgctatcaggctttgttaggaggaggtcagctgggttgtcagattttagcatctcctcaggaagcaggttaaactctctggttgttagggagagaccctctcctacccctccagccccaccaccccaaaccacttgccaaaccagtgaagaaagggaacatggaagcctggatgttcattcccacctggaaagtttctcccagagctctcaactttggatgtaagaatcatcttcgataaataattgcaccttgggatgaattttgtaatttaagtttattttatgtttttagagacaaggtgtctccctacgttgcctaggctgatctcaaactccggctcaaagactcaaagaagcctcctgcctccgtctcccaaagtgctgggattacagccacacctagccttggggtgaattttaatgaagccctttagatccttgatatttttctgcactggagtcattgaaaatggcctcaacacattaactccaggttctgtccccttccttcccttgtgtgagccctaaaggctgcaggtgaggaagacttgggtcctttccctctggtcaccattacgggctttaattttcagtaaataaatatctcttaagtttaagggaagaaataagcactctttttttattttattttattttttgagatggggtctagtcctgtcgccaggctggagtgcagtggcgtgatctcggttcactgcaacctccacctcccgggttcaagcagttctcctgcctcagcctcctgagtagctgggactaaaggcgcacaccactacacccagctaatttttgtatttttagtagagtcggggtttcaccatgttggccaggatgaaattattaaggacaggccttaataatttaattattaataattaaggacaaggatggtcttcatctcttgacctcatgatccgcccgccccagcctcccaaagtgctgggattacaggtgtgagccacggcgcctggcctcaaaacaagcattcttaaccccaaatcacacgtctgcagagattctggctgtcaacgtgatgctggggtgaaggcgaccattgcgaaaatgtgcaatctttggtcggcatctcagtccagatggactcagtgattgtcttgctttctcacttcccttgggtattgcagaactgcagcccctgggatttggcatccacgtgacatggctccttgctgaggcctgcttccgatggcctttcttcggtcaatgcacagatctcagtgttgtcttaatcttcaagcaaccaggctggtctgaagtttttcagaagttttggagtttggagagatcatgtctcccatctgtttcctgttccgtttttctgtacttcctcttctttctcctgcaccagtgactgggcacaggcggccactggacagtcactccctgtctgcaataaccagagtctctactgatgattccgttatccttgcaggtctgtcactcagtctcccccaagacacactaaaatggaaagaaatgaatgacttgggggtgggcggcttttcttgcagcccaggatgaagctctttcacaatcctcagggcatttgtggtgactctgcagtaggtttaagtccagagaatgcaacatacattttagggactcttgatagttactatggtaatttgaggctttgaaaaatagaaatatgttctggggaaaaagtggacattacatcagatgcaaaatgctcaaccttcaagagcttcatactactaaagatgggtgaagaaaggaggagatgtttgtggtgaaggccattaaaaaaatcaaaagcaaagattgtgaaaataaacaagcataaattggattccagcataaagataaagaaagatatttttgggattacaggtggtggctcacgtctgtaatcctagcactttgagaggctgaggtgggaggatcacttgagcccaggagttcgagaccagcctggccaacaaggcgaaaccccatctctactaaaaatacaaaaattagcttggcatggtggctgcacttgtagtgccagctactcagaggttgaggcacaagaatcgcttgaatgtgggaggcagaggttgcaagtgagctaagattgggccattgcacttcagcctgggtgacagagtgagactctgtctcaaaaaaacaaaaaaaaaaaaaacaaaaaaaaggaaaaaataaaaagatttttttttcagttggcatgtatactctgaatagtttcacttgatctaccaaaccaaaatagcacatgcttaaaggtaaataattcttagggctttaggcttcagtagtcaatataaaggatgttggtcctacatgaagctaggggcaactcccagacagcaaggatcttgttgcccaagaggaaacagagtggaaattcagcccttgccccaatccctcagctttccatggaagtggaacagccaatggtgacaaaatacagcacattttaaacaagtgctagtgatataatgacacaatgatataataatatatatgaagcctggacacagtggctcatgcctataatcccagcactttgggaggctgtggtgggtggatcacctgaggtcaggagttccagaccagcctggccaatgtggtgaaacaccgtctctactaaaaattaaaaaattagctgggcatggcggcatgcgcatgtaaccccagctactcgggaggctgaggcaggagaatcgcttgaacccaggaggcggaggtcacagtgagccgagatcgcgccattgcactccagcctgggcgacaagagagaaactctgcctcaaaacaaacaaacaaacaaactacatgtatatatgtatatatatatgacacatgtcattatatatagtacatatgcatatcatacacactcacatatatgttatatatgtaagaatatatataaagtggtcgggtgtggtagctcacgcctgtaatctcagcactttgggaggccgagatgggcggatcacaaggtcaggagatcgagatcatcctggctaacacggtgaaaccccatctctactaaaaatacaaaaaattagccgggtgtggtggcggatgcctgtagtcccagctacttgggaggctgaggcaagagaatggtgtgaacccgggaggcagagcttgcagtgagccaagggcgcaccactgcactccagcctgggcgacagagtgagactccctctcaaaaaaaaaaaaaaaaaaaagactatatataaagtgttcttttccagtaacacaaaagtcaggcttattataagaactagctgataggtgggtgagtagttcccattaaaaaaaatgatttgaggtacttaaagaaaactgtggtttttaaaaaagatgatcattacagacaatggggtagattgcaaagcagactgaaatggatcttcagagaactgctaccatggatccgtcatcatttcaagaagacatctcccaaacaggtagggctctcttaaactaagccttcgctcctggtcttgctttgtataagagatgtttcttttaatttaatttaatttttagacagggtctcactctgtcacacaagctgcagtgcagtggggtgatcctggctctctgcagcctcgacctcctgggttcaagtgatcctcccactttagtctcccaagtagctgggactataggcacacatcaccatgtctggctaatttttttttttttgaagagtctagctctgtcaccaggctggagtgcaatggtgtgatcttggctcactgcaaccttcgcttcctgggttcaagtgattctcctgccttagcctcccgagtagctgggattacaggcacgtgccgccacgcccagctaatttatatatttttagcagagatgggctttcaccatgttggccaggatggtctctatctcctgacctcgtgatctgcccacctcggcctcccaaagtgcttggattgcaggcgtgagccaccgtgcccggcctcctggcttattttttaatttttttgtagagacgagttctcactatattgcccgggatataagccacgtttctaaagcgcactcagatgtgcctgcctctgaagtctagccacccacaggagggaggacaagtcatgaatgtggtcatttgaaggccccaaagggctgtctcctttagttccctttccttacccagcagatggtacagagtagctccaggtatgtttgggtagatggtgcctcttaagtcctgggttttccgtgacagttgttccctcaaataccctctgccatacttaaaccttgcatcagctcagctatcagacacggacttgtgttgtggaaacaatggtctctgtggcccaatcagacatcgggcttgccacaggttaacttcattcttggctatgatcaatgtggagaaattgtcctgggtgatttaggaatgtttggtaaaaaaaaaaaaaaaaaaggccagtccacgatagacattttatctgaaagatataataattatgccatttttcagctcctccttaaaaaagggggtcgagtcactatcccttagcagttcattgtttccaatttggcttaattgaaactgagaaagttcttaaagtttgaacagcagtaattaaatctgaattggatgggatatttgtaattttgaatgcttaaattttgagaggaaaaaactgtgtaatgttgttggccaaatgaccccagtcattaagattcctatggcattatttagttagttggctttttataacgccacgaggtttgctgtgggctgccatggacgccattggcctcacaaggagaagaagcattttagagaagagcctctgagagagagaagcagccccttaagagtctgctaataattggcattagcatttctggacttctcgggatgcaggaactgagatgagttgaggaaaatgaacagaagtgacagtttttgtgaggccaatggaaaccatgtttggatccaggaaaaaaaaaatgagacaggaaagggagggtcacatttttggaggaaatcatgtggtattttggtaatcctttgttgatgaaaaaaattaccagcacattaattatgtcctaagaatgggacactgcaggtctgcatctttgttctttcccaggctgggacagcagccccggcatttaccactctggggattagaaacctgggttcctggacacataccatgagtacctcgctacagtgttgaaatctaacccagccaggagttcaggagataggaggctttttttcaagacaagtaatgacaactgaatagtttaaaatctttataagactggtagtattctgccagtgcaaagtaataaaactaaatatgacatgaaagtccttttcttttctttccttttctttctcgctcccttccttcttctcttcccttccttccccctcccttctcttttctcttctttcttttaaaaacttttttttatcagttatatacacttgtaaacgtttttcacaagagttcaaacatttacatttagacatatacagcataaaccaacattgacccttattcttctagattctttaggtaggattgagtacatcgttgccactcataagcaaaaagcacgaagctggaggcatcatgctatctgacttcaaagtacactacagagctacagtagccaaaacagcatggtactggtacaaaaacagacacatagacgaatggaacagaatagagagcccagaaataagactgcacaaccacaaccatctgatctttggcaaagctgacaaaaacaagcaaataggaaaggactccctattcaataaacagtgctgggataactgactagccatatgcagaagattgaaactggatcccttccttaaatcatatgcaaaaatcaactcaagatggattaaagacttaaatgtaaaactcaaaaccatgaaaaccctggaagacaacctaggcagtaccactctggacataggaacaggcaaagatttcatgaggaagatgccaaaagcaattgcaacaaaagcaaaaattgacaaatgagatctaattgaactaaagagcatctgcacaacaaaagaaactgtcaacagagtacacagacaacctacagaatgggagaaaatgtttgcaaactgtgcatctgacaaagatctaatatccagcatctataaggaacttaaacaaacaaatttacaagataattaccacttcctttagaagaacgtgatatattagatgtacattgccattgtggtaaaaatggtcacgcatttttctcccctttttatctaagtccttgggtggtgccctctcacagactctggtctggccatatgactttttttcggccaatgggaggatagctaaggtgacacaaacccaaactggaaaagtatgtgtgcaccagggcttgctatcttgctgtcctttggagccctgaggccaccatgtgaagaagcttggggttgcctgctgagaaataaggaaccacttcagctgacacggagcctactccaggccaccaaagggaggccattcttgtttatccatctcggtcaagccaactcagactcggagaatggcccagcttccccaagaattgtgagaaataattgattgttttaagttactaagtgttgggatactttgttattatggcaaaagctgcataataagccataaccaaagttgttatttttgtcctttaagctcgattattatattatcattattattttttgatatagagtcttgctctgtcactcaggctggagtgcagtggcatgatctcggctcattgcaacctccacctcccaggttcaagcgattctcctgcctcagcctcccgagtagctgggactgcaggtgcgtgccaccatgcctggctaatttttgtatttttagtagagatggggttttgccatgttgaccaggtgggtctcgaactcctgacctcaagtggtccgcctgtcttggcctcctaaagtgctgggattacaggcatgagcctccacgcccggcctaagctagattattagggacttctttccttaaatataaggcattgtttggatatgtgatgattagctgttatgcaatggcagtgctccctttctgggtaagagcattgttccctttccttatccaaactagaaaacctagaaaatgtggataaatttctggacacatgtacccttctgatgctgaagcaggaagaaattgattccctgaaaagaccaacaatgagctccaaaactgaatcagtaataaatagcccgtcaaccaaaaaaagccaaggaccttatgagtcttcctgagtagggagtatggtgatttgcaaaggttgtttctagcatgttgatgaccttctttcacaggaagcagtgtttctcattctagctatcctgagcaaatttctaaggatgagaactccacacccacacagggcttagcaggtgtagttttctgtcccctttttttttcctaccccacagtcacgttttctaaactctgagcctccctccatctacatagagggtttaaccctccttccatctgcatttccctcattactgccatcataatcacattccttaattgcttggttcaaggtagcatctttcttaccatgagtgcaagaaagaaaagatatttggattgctttaccctttcaagcaaaataggaatcctgtcacggcatgcttatcatgcttattcttttcttttctcttctttttttttttttttttttagacaggatttacaagataattaccgtttcctttagaggtacataatatattagatgtacactgctgtggtggtaaaaatggtcacacatttttctccccttttaatctacattcttgggtggtgccctctcacagacactctggtctggctataactttctttggccaatgggttgatagctaaggtgacacaaggcctttagaggtactggctctgtcacccaggctggagtgcagtggtaccatctgagctcactgcaacctccatatcccaggctcaagcgattctcctgcctcagcctcccgagtagctgggactacaggcgcccggcaccatgcctggctaatcttttaaacatttttttgtagagatggggtctccctatattgcccaggttggtcttgaactcctgggctcaagcaatcctgtctcagcctcccaaacttctaggatcacaggtgtgagccaccgccctgcccacagtcactttctaaagttagacctgaatgacccctctccttcataaagtcgtctccaaccacctcggatcatggagctgctttgctcttctgaattcttacagccttagagtctcagtcgctcaacggttattgatcacattccacgtgcatgctcatttatcatactgtcttcagacttgattatgtgctatttgtggaagggattatatgtctttgtgcctccaaagtgcctagcagagggcattgtttaaggttggtgctcagtagacatttggcactgcactggtttccaacctttgctagcagcatttctcaaagtgtggtttgtgtattcctgcattagcatgatgagaagtgcttgttaaacactgtctcaccacctctcggccccttctaagacctactgagtttgcctttctgctaggaaggcccaggaatctgcacggtaaacaagctgtgcaggtcatttttaggttcataaaaatgtgagaatccttcttttctgcagtgggcaaatttaatccataggtggcctgttggaccccttacttctttatgcaaaacctagggatcctagacttactgaaacttctagaactcagaattgtgactttcaactgagaagaagaggggtgtgtctctaagaaacagggtttgaaaggtatcatttgagataataatatgatttatacttgggaacagcccattgttataatgatacaagctacaggcaagtggagaatgaccaaatctcagttggtgtgatgcataaagaatgctgaatggttagcttaatgactttatagagcaggggtccccagcccctggggcacagaccagtatcaattcatggcctcttaggaaccaagccacacagcaggagttgagcaacaggtcagtgagcaaaggttcgtctgtatttacagctgttccccatcgctttcattaccgcctgagctctgcctcctgccagactgcagtggtattggattgttatagcagcacaaaccctactgtgaactgcacatgcgagggatctaggttgcacactcttcatgagaatctaatgcccaatgatctgtcactgtctcccatcacccccacatgggactctttggctgcaggaaaacaagttcagagctcccactgattctacatgatggtgagttgtagaattatttcattatatattccaatgtaataattatagaaataaagcacacaataaatgtaatgtaatgcataaaatgattctacgtgatggtgagctgtagaattatttcattatgtattccaatgtcataattatagaaataaagcacacagtaaatgtaatgcaccacacccggctaatttttgtattgttttgtagagatgaggtttcaccatgttgcccaggctggtcttgaactcctgggctcaagcaatctgcccaccgtggcctcccaaagtgctgggattacaggcttaaccactcttaaccccggaatgtcgaattttccacaaataaaaatatttattttcaggtaaatctaaatgagaaacaaaagggaaattcttctaaactcaaggataatgatgaaagagttgtctctaaagaatggtggtcatctgtgaattcagaattctaactacgtcctcagaaaagagtcaggctacccatgctgctggtcttatatggcatgattcatccacggagctcagattccaggaacatgtggtcttcaggtgttttctgtagcttttccctcaggatttgatagtgattggtaggcagcatttttcctgtactgatgtctttgacacatagatggccatctttcattcagtcgggacaacacatgtattttttctagtttaactctgcctggcttgattgcctaagtccatctattcacaataaatatacaattgtcccatgagacagcttaatgcaataagcacatactgagccaggtgcagggattcggagacctgggggatagggtattctaaagacctaacaatgagtcctgtctccaaggttctgacagtctaatcaggtagacaaaatataaaggcactgggaaagggacttaataacaaaaccaggctgcagattaggggctacaagctggggctcacaggccaaatccagcccgtgacttgtttttgtaaataaagttttattggaactcagccatgtccattctttgatgtattctctatgatgcttctgtgctacaaaagcacagttgagagtagttgcaacagagacagtatggcctgcaaaaacgaaaatatttgctctctcgacctttatagaaaaagtctgctgactcttggaagtggatgattaaatactaaagcaagtgaaaggacaatagtaagtggactaacagttcagaagagtgcacgtttcctgcaatgtttgtgtgtgtatgtgagggggtagctttttagaggaagtgaggaattagagaaaagtagaacttggacaaagagatgagagagatggaataatccaagggtatttggtaactttccatatcaatattttacataaataaataaataaaaatactactgttaattttaaggtagattatttaactgaagctgtatgtttaataataacattatatttccaaacactttcactctctttcttgcttgccatagtcttgtgaggtaggcagggtagtaaattaccccagtttggcagatgaccgtcagagaggttggttaaaagcctggctgtaggtggaaagccttgtagagctgctgagccgatcctgcaactgccgcaaggttctgatttttatagggagcccacaggagaacttggcaatttgtgactatgtgcagcagatgaaacaataagaaatttgaaactaaatccttttattaatttttataccaatttttccatttcctgaatctctctgtccttcaataatgctaggctgtgagaagctgagtcatgcatgggttgactgtgggtctggatataaggctatgtttaaatcctgcaaagcaaagagaagcccaaagacatggatgtgcttgtcactcatcctcttgaaagcctgagcatctcagatctttcaaggaccagctcatctcccaaaaacaatgtggctgatgcccttaggaaatgtggggccgggcatggtggctcacacttgtaatcccagcactttgggaggccaaggcgggtggatcacttgaggccaggagtttaagaccagcctgaccaacatggggatatcctgtctccactaaaagtacaaaaactagccaggcgcagtggcatatgcctgtaatctcagctactcaggaggctgaggcaggagaatggcttgaaccggggaggcagaggctgcagtgacctgagattgcaccactgcactccagcctgggtgacaaagtgagactctgttgaaaaaaaaaaaaaaaaaagacaatttggaacccacaccatctatttggctattgccaacacttcctgaaggctttgccatggaccaagcattctcattaatgctttatgtgtttaatcctcacaatgacttcaagaagtaggtactattatgtacctattacacagatgaggcaaatgagttgcaaggagttcacccacttgaggttagacagctaatgaatgtctgagtcaagattcgaatccaggtcagaacttgcatccttatttactgcattcttccatactgccactcattgacaagcatggggatgcataattttgaatcatgctcaagaagtttggaaccaaaagatgctatgcataaactgcacaggaaacgtccatgctctttgacatgacgaggtcagatttagaaagctgtgaacatggacctcaaaaaatcctaccaggttctcagtcttacagatttctcagagggaacacagggagggcaggaggaatgcaaggtccaagctggaattaccccaacccggatgcaaaacacgccggcagctgggaggaaaaattggactaagttagtatatttggggacaaaggtggaagaggctcaagcgcagaaaatgtttcaacaggactccaaggaggtcttgtacgattatgctcaagcctctgggttcttaacataccacactttgccccacttcaatcagctgcaaggaaccccatccacactctgcctgggccccgcctgtggcaatgtgtctttgctgtggcttcattctggagttgttgcggaggaatcagatattggcagaataaaatggcaaacttggtctatggaaaatgtaaccagacacagaaagtggaccgagcccacctttgtcagcgtggcctgagtcaatcccattaacttcaagtcagtggactagactcagaaaatggcaaatcgctggagtcttttctccctacccctccccaccaaagcaagagcctagctgtggggtagagtacgtgttccattacgtctcttgggctactcttacgagctggcccctctaaagaataagtttggggaataaaaataactacctgggatatcaaagaaaaagaagccctgggtaagtgaaccaggcaattcccaacaatgacatggatagtagagttgaaggtagtaattatattttgtaccaaattgggggataatatagaagagcacaggacaattcagaatgcctggaatacattacgactgtgggcctaataacaggtttatgtaatttaatgagcagaaatatgaactataaaaccaggaggataaactgagaaacaagaatactcctggagggcttgggatgggcttttaaaagatgtggcagatattctccccaaattaggggcaatatagagagtcgcattggacctaagtaaattattcactcctgtgtagcagatttttaaggctttatctcaaagctgggttcagcttgagccacctattataaaatacaaatggatatgtgaaaatggtcagaaacccatgccagaaattggtgtgacatggagatttatggggcttcatacaccagtgttatgaactgcctggtctgtggccctctaaaaggaagagattccgagtcgggtttggacaaacagagacaaatcaagaaggaagctgggaacagttgcaatgagattttttagaatgatggctcaagtataaagaacttgaacctggcaggcatttggataacatttctggatgctttaaggaagttatggctagacgaagccaccaagagagcagtcaactcagctcaaccaatggaaagagagaagcaaggaagggccggattgggcaagagcacggggcagcattcactgggagagaggcagggagggggtctgctgcatggttacccttgtcaggttaatttcctgtgtgctccctctgatttgggggaaactcaaggaggatgttttctccttcaaacatttgaaaagctatttttagctgtttttaggaaggcaggaacaagagcattcctctctcaaaccgcaagaaaccttcatgaatatggccagaaattgaaagtaaatttgttattacgttgcttaagtgatttgagccttttcagagtcacctgaggaccctccagacagggaaaatcttgatgagataaaagtgccatctgaacaaagtgcatcagaatgttgcattccttaatgtcattgacaacacaacacgacacaacacaacacacagcatcctcctcatgatttccccgaatgagatcagtttgataaattagctccaaactatagccacagtcccttgcccattggaagagtttctaatagctgttctgttctctgccctgcaaagatgataatctgaggttcctcagctgttggatggttaatgttttgttcttgtacttattgcaaaattggggaaaagaaaaactggctttgtaactgtattggccttgagatttacctgataaacaacactgagtaataggattggaaattctcttaaaattttttgcacattatttggttacagtttccatatggcaagaaggcaaggggagaaacttccattctggaccagcccccctccctcccagccacacgtttaatccatgtgcttatgtcaaacttaattacaggacttttggcataaaataacagtccacatcctcagagagaagaacttaagcagttaatatgtgcgattgagtgaaattgctttgctgaatgtttatgagtaacccaagactagtgaaatgtgctgatattttaactgtttcagtgctgaacttgtgccaagatgctgtgaaatagaaaaaaaataataataatttcttccgatctgctgtgtatcatatttcttgaaactgagaacgttgggtaagacaattttatggctctttcacaaatagctttgtggagaaaaaaacaataaagctagaacaattatggaacttgtcaccagctcagggaactgcagagattcaagagaagaatagcaacttcaaactaacatccttttctgcagaaaattctcttgaatattagaggtccccaccaggggcaacaatttttgccttcggattttcacctacccgcttgaaccttttcagacacttctgtttcccattcatccccagtctaatgtgaatggttttaaaatgtagagatttccaaccctaaaacgactcgatgcttcccactgtcatctttgctgaaataaattcctacctctgtttaaatgttcttttgtctaaattgttcacagttagacctgctccttttagctctagaagaacctcttacaatataaaatcatctgcttattttccttccttttctaatgctctttcttatactagtgagatgtagagctacttctgaattcatagttcttttcattacttttgtttcaaaagacttctctattatcacctgccccataaatgccagccttttaacactatagtttcttttgttttctttctttctttctttctttctttctttctttctttctttctttctttctttctttctttctttcgagacaaagtctcactctgtcatccacgctggagtgcagtggtgtgatcatagttcactgcagacttgaactcctggactcaagagattctcctgcctcagcatccagagtagctaggactacaggagtgcctggctaagttaaaacttgttttgttgtagaaatgcagacttgctgtcttgcccaggctggttttgaactcctggcctcaagcaggtctcctaccccagcctcccgtagtgctgggattgcaggtgtgagccactgtacctggtccagcattactgttttggaagcttctctgtacctaaatgttctactgagcccaaattctcttctctccattctctccaaacccacattgtccctccccgcaattcccccaatctgtccccagactgttgggaatgtattcagcacttgttccaagggcaacagaatacaaatgtatcatctccatccacaaaacactctgtgcaccatctcaggatctccagctagctgccctctgggtttcagcaataccgaccgtccactccgctttacacctctgctccctttcaagtcacctccttgtccacatctatgacccttgagagcatggcaccctttagttttgctgactgccatcttcccttgctacttcaaaatgcttctgaaaatgcattttctcccttatctgcgactccaaacttcattcagcttatatttcagaattatttttagaactattgtttggttcagcatattagaatcctatctttgagaaaggtgcaataaggttagggtgttgaaattggaggatatttgtgagggtacctggcacatgcctggtacatagaagacacctactaaagttcacttatttgttcattgataccttcatttgttcaatgcatattgaatgcctaatacataaaacgattacatggtaacaatgccttgagtcatgctaggtggtggggattcagatatgagagatttgctgaaatagactaagggcatactctgaacttttcctacatttcaagcagagctaaccaacaatctagaatgttggtattatgaatctcttgtattatttttaatgcaggttataaatatgtaggcctgaaagtcatatctcatggtatgacctcacggtatgactttcacttctgggcagtatctgggcaacatggtgaaaccccgtctctactaaaatccaaaaaaattagctgggtgtggtggcgtgtgcctgtaatcccagctactcaggaggctgagtcaggagaatcacttgaacctgggaggcagaggttgcagcgaggcagaggttgcagtgagccaagattgtgccactgcactccagcctgggcgacagagtgagacgatgtctcaaaaaaggaaaaaaaaaaaaaagtaactagtgagggaaatcttcttttggcatagaagtgaaatatttcagtaaagtatcaaggttatgcccagtatggtggagacgcatggattcttgatattaatggatgacagacattctttgcctacctctagtaatccttcaggtcttagatcaaagctgttttttcttgaggggggctttctctgacccacccaattgtaaattaggtacccctgttgtaggttctctcctactctgtactcttcctttgctgcatttattacaattggtagttgcatatttattgtgtgattatccattgaatgtctgtctcccttaggacactgtaagctccatggaggcaggggccatatccattctgttcaatactcaatacccaatctccagcacagcacctggcacatggtaggcactcagtaacacttgtgggatgattattaatgtcctgatgctaactgcgaaagtgcagacagtccataaattgttcatttactttggaatcagctgtgtaactttttgaagcatcttcctttcactagtttttttttttttttttttttttttgagacatagctccactttgtcacccacgttggagtgcagtgccacgatctcggctcactgcaacctccacctcccgggttcaaacgattctcatgcctcagcctcctgagtagctgggactacagtcacatgtcaccagacccagctaatttgtttattttggtagagacagggtttcaacatgtaggctaggctggtctcgaactcctgacctcaggtgatccgcctgcctcggcctctcaaagtgctgggattacaggagtgagccaccgtgcccagccctcactagttactctgatgcaggttattgttgaaatagtttgggtgttcactggccagctgggaagaagcggacagaaacagttgcttgctttttgcccccaggacagctttgctgatggggctggcagaagatatgctgagctaggaaaggtcaaatcatcagagagtctgggaggtgggaaaagctggacaaaggaaaagaatgacctcgggatcttcctgtctgtacttcctgtctccccaggaagtgtcagtcagagattttcaggaaagggtgttgtcatggaaacctgaattggctcttcccctccaggctgtatggggacaagtgccctcatgtgccccagctgtccccaggcttgtggaagagggcagtcagtttgagttttccgacgcaccgtggaaaatccagagccgacaatgtctgggactacagaaccggcgacagcgtgcggcagggattcaagtccagaatgcggtggaacctgttatgaactaattaaaatttaatctgctaaagccattttctccatcatttgggaaccctctcttgacttcagcaagttccaaagagcctctcaaatagaggatgctgtatttttgcactttttttctctgtgtattagatttcatccccccaaaaaagccctttttaaaaagggattctagatagagtagccatataatttatcatccaaactgggacgcttttgagagtgaaaagaagtgctattaataattactctgggataatagatacaaactgggctgttccggggaaatgccgaggtatcttcaaggaaactgtagggtcaggcaccgatcaaatgcatccactgggctgaaagcctcaggcagaaggagctctgtctgtgtgactcttgtgccttggatagtgcttggtctacagtgaatgtgtaaatccacagttgtcctgggtgtgccttctgaacagaaaatggcggggggggcggggtggggggcgggcagagtgaacccagacgttccttgcaatttcacagccgcaaaggggaatctgtgttcctgcagcgcaggcaggtacacgatgcataagcgtctgtgtattctgtgtttactgattcctaactgttagcagttaattgccatctgttgacacaccctgagggggaatgttaagcagttctcgacatctgcatatatattctctgcctacatattttactaactcttgtttatgggacccatttcctcaaatccatgctactgtgcccctgattttgtaacatacacgtacccggtgtcaacctttggggttgaatgggcaaaaatgccctcctcaactgttcccaacacaaagaaatactaaatgcttgagatgatggctaccctaaataccctaatttgatcattacacattatatcaaaatatcacacctaccccatcaatatgcacaatgattatgtatcaataaaaaaatgggaaaaaattcccttttgggtccgccagagatgctgactgcagaccgggtcctgcccagactcgccagccactccatttcccacccctcctccacccgcctgccgggtccttcaggaagagtgaaatggtccattgatccctgaggaggaaaagagcatgttcggccttttgagaggttatggacactctgagtgacacccgagcccaagcctccaacagcaagtccggcagccccggggtgcaggggcgaggcccggccttgtctctgccatccacgtgtaatctggccctgaaactgaccagctccgacgccctccttcctcctgcccgccaggcgcttcgtgttcttcccatgtcttgggagagatccgtctcctttgacagactcaagattccaggccgaactttcccatgccaccgtccctcaaaatagccccagccgagctgtatttatagccgtgtgagactctaatgggccaatttgtttgaatttccactgcttttgtgttgaacttacccctctcctgtgggcagtctcttcaggcctttattgatggggtgtgtgaggatggcgtaggccgtgttcaagatggtagctctatagagcgtgggggctgttttgcatatttactgttctttaaagccggttttttgagagagagaaagagacagagaaagaggtttctgtaagtagcccggacaatgagaacaagaccggctgtatgccaagcacgggatcccggccaaaacacatatcattagcttggaccagctataagcaaggaaatgagaaacatatgctaggagcaaggttaggagtgaaggaccatgggtcattgacagtcgccctaaaacttttcccttgttcttcagctgtggcctggcggtgtcaaatgtcatttcgactgccttgatttctcatggtggggctgcctgtggtttttttttttttttttctttctttctttctccccctgctgtttcctgatgggactgtttttttgtttttttttttgttttttttttttttttttgggaggggaaaagagaacagtcagggaagggcttatgtgatagtttttctcagttctgggaaaataaccttgtttcctgtgatgcactcttcaattcctcactttctctgaagcaacgatgtctctgggttttggatccatactggtttgagaggggaagactgaggggaggcttttaaagcagttcttgctgtttctttcttaaatataattagatgcgcctcattacctcacactgaaggacttttgtactttttcgagctgtgttttctgagatcttccgtgggcgacggcttgtcgtttccacttgcagttaattgcattagcaggtattttccccccgcccctcccgccccggcatatttgtcctctcttctcgctctccccaagatatctggagtcgattttgcgagtccgaaggccacacccagggagtctgcttgtgcctgaacgtgatgaaggatctggattcctttggcccttcccagtttccctttcctccacctcattcttttttcttaaagtcttccccggacagtttactaacaatgctctgctctcttgcactccaaggtcaggacccctgttccctataaaacccagatgaagaactgtatccatgcaactcagaggcggtccctggagagcatcccatgtggctactgttctgaaacgaccacaaccgcccaggaaactcaccaggctccgacacccaggtttggccaaagtcacaagatagccacggatataccctgccattcccatgaagggaacgctatagaagtgggggcgcagggcagttgcaagcctgtatggcagaaaggggaaggaataaaatgctctcccataaaccccttcggaccttcattcctttaagatttagggaatggtgttggggtggaaccatgtaaaataattaaaacattcggtccctgtttatcttttgcttccttctctgtgccttgttctgaaaataaactttgcagttagtttccgggctcccaaaattcccaagtgtgtgagcgtcctcaaggctttgggcagagttaatgaccggcttgaggttcactggacgtgtttcccccaggcgagccacctttttttccttaacttcagtttctgggtagcagatctctcttctctgcatggagaccttcctggtcacaggaggaaacctcacttgctgatgccttctaaggcctcagtggatcaggaatgggtggtgtgtgtgttcacacaaaacaacaacaacaacaacaacaacaacaacaacaacaacaacaaaaggaggaataagggctgccaaaccgcaacatgcaggcaacgggcatttaagttttatattgacagcgaggcaggatcctggtcagatacctgaaactcttccaatttcaaggaatctattccgcgactctctctcttccctgtctttagtggtagaagggggctggtattaggtttgagttcacgtgttttctttttgcatcctcactgcttgggctgcctctcaaatctccacacagccaaaacctgcctccaacccaccatttcctgtcatctcctccactgtaaccctcctggcccagtcacatctcctcttgctggaaacctgtaatgccttctaaatggtccccacactcttctcctgccccattgcagtccgctcatcaatgagcgacccagagggatcctttaaaaacccaaatcagggccgagcacagtggcttatgcctataatcctagcattctgggaggccgaggtgggtggatcacttgaggtcaggagttcaagaccagcctgggcaacatggcaaaaccccgtctctactaaaaatacaaaaaaaaaaaaaaaaaaaaattagccaggcatggcggcacatgcttgcaatcccagctactcgggaggcaggagaaacgcttgaacctgggaggtggaggctgcagtgaaccgagatagcgccactgcactccagcctgggtgacagagcaagaccccctctcaaaaccaaccaaccaaccaaccaaatacccaaatcagattaagcccatttccctgctgaaaaccccacttggcctggtgtggtggcttacacctctaattccagcactttggaaggctgaggcgggcggattacttgaggtcaggagttcgagaccagcctggccaacatggtgaaaccctgtctctactaaaactaaaaaaattagctgggcatagtggctcatgcctgtaatcccagctacttgagatgctgaggcaggagaatcacttgaacccaggaggtggaggctgcagtgagctgagattgcaccactgcactctagcctaggcaacagagagagactatgtctccaaaacaaacaaacaaacaaacaaaaaaaccactggtggcccctgcctgcttctccaacttggtcttgagccatctccccttcaccttttatgttccagccacactagcctcattttcatcaccagtagagtgaggatgtaacaacgcctgctcagagggctgggaggagtaagtgcattaacacacacaaaacatctagaccagggtctggccatgataggtgctcgataaagggaagtgccattaacagtttacttctttgaatttgccaaggacttttcccgcttcaagacctcacaaaagcctctgtcacttatcatttcccctttatatggctggctcttttttatcctttgggttcaagtttacatgttaactctttagagatcttctctaaccagtctattcaaatacattcccaacgcttgaacccccattcccattattttctcctacaacaccctgtctgtttccttcaaagcactttttccaacttgggatgacaaatgattttttacttggggggcagggctatgtctaataatcttatccagcacaaggaatatttgtggaatgaatgcataaatgaatgaatgtaactccttacctttcttctgctaataccagagccatccccaacccacctcgtcggctatgccaattctcctctccaaatcctgtatttacttattctctcatcctttggcattattgactctctggtctcttggcaatggaaaaacctctaaaccatctagcaccgtcccatcactctaggaggctcacactttcatttatatgtaaatgataaataatagaatatgtaacgcccagaataagttcaatgactaatgactcctcatctgccaagtcagaagggtttggggatgaattaactcatcaactaccattaagagatcaatgtcaatgcaattactccataaatatccaagatcaggtatcttacagtgctacctgaaagtctcaagtgatgataggaagtcaagtgcaggtgaaagcatagttcccatttttgttccttatcacctccctttatgtgagtacactgtattatattgaagctgagtaacatgagctaaggaggagtaacttgacctgtcctcatgcatctctctttcttgctctcttagccaagaataccaagatggaaaatgccctcggctgaattttttattatttattgattgatagccttcttcttcttctccttttttttttttttttccttaaacctccatgcactttgctaattacttctctggaaatcatttccctttaccattctccagaatgctgccacctttgggaaggaacgtggcagtgtgataaaatgtaggctagacaagagctaagagtggaaaaaagtcttcttcttgatgtgctggtccagccctatcctgccatctaatatgctgggaatgcaatgatgtaataatgagaacaagcacaaggcttgcatcagagcaatttttttcatccacagaataagcataaaggaaagtgccttcatcatttcatcttcggccccacctagatttgcagcatcagcatgactaagtcatggaagcaagctgatttcatcagcacattggaggcacttggtccaattaatgtgacttgaaggtgacatttgtatatccctcagaccaaaatactcaatgacgtgagttattagaaaaagcccaaataacgattaattcctaaaattaatatctgcactccagcctgggcaacagagcaagactccgtctcaaaaccaaccaaccaaccagccaaccaaccaaccaaccaaccaaatacccaagtcaaattcaaattgagtgagataatggttggagggaaaataaaaatatcttccattctatgcaaaagaggctccagtgctttgtagctgtttgaatgggtagcagataaatggggtttttggaaatgaactttctagaattttatagtgaaaacttgcggaacaaaagagaatactaatgttaaaggggaaggagaaaatgtttctttaatgtgacacatatcgtcataatggcaccttacatttagagattacttttctttggaagcgtatgaaacattatgtgcacagcattgtgagccgcaagaacataggtatccctactttaaagatgggaagaacagattcacagatgtgatctttcccaaaatacacagaacactggcatacagccaatatggttatattaccattcaggagtttctgtgtttccacagatctcagactagaccaaatacaattttttgggtagtggacttgaatagaagaggcagccaattcctatttaactgaacaaagaaagtaaatgttgattgtgtttctactacatataaagagtaggaaagggataggccttgttctcaaggaatttatagcttagtggaggagacagacatatgagctcactttaatgcaaagcactgttaaataaagcattgagcaagggacactgacaattagttgtggaggcgcggtagggaaagagctgctgcgaacaggggctgctatgacagtcagcctcacgtgaaaaacagaaagacccatcagtcggggcgggctacctctctgcaggcatcagggaatccttctagcttccttactctgagctgagatctacctaactgtagcttccaccaggtgcttctagctttgtcctctgaagcaatgtaaattagtttaatccctctcccacacaccatccttcaaaattctaaatgtggatgactttttcttttttttttgagacagggtctcactccggagtacagtggtgtgatcctggctcactgcaacctctgcctcctcagttccaacaattttcctgcctcagcctcctgagtagctaggattacaggcacccgccacaacacccagctatttttttgaatttttagtagagatggggtttgaccatgttgaccaggctagtctcaaacttctgacctcaagtgatccgcctgcctcgtactcccaaagtgctgggatcgcaggcgtgagccaccgcgcctgaccatagatgacatttctttccttctccccagtgcccctaccccaaagactccttcatcattttcctcttttggattaaatgtgccaatttcttcaactcatttgtctatggcatgattccccagtccttcactctctagcattcttctcttgataaattccactttattcatgttcatccttaaacatggcattgaaaattcaacacaatagtttattttatttttatttttgttgagaccaggtctcactatgttgcccaggctggtttcaaacttctgtcctgaagcgatcctctcaccttaaccttccaaatagctgggattacaggcacagaagcatggcagaagcaatataatattttagatatgtgttgactagtgagtcagttccatcccattatccgtccatccatcctcccatctatccattcatccatccatccatgcacctacccacccaacgatacgtaaataagcttttgttatatgaagcactgtttagtcactacaggggatacaatgatgaaaattgtaaatgaaagtcaaattgagtgagataatggttggagggaaccatgctcacaccaacataaccaaagattttattagtgtttttggcagccgtaactcatacagttagcatctactgaccttgtggatacctggacttctaatatattctcaccaaatttatgtttacacagattgcccttgtttggtggcttggcatttgatttctggaaccaaagttcagcactatacattgatttttaccattttaagtttcagtcaactgtttacttcattgagatcttttgggaatctagatcctgtcctctgacatcaaaccattccttttatttctgggccacctacaagtaacacaagtagcttagcccagaaccttgggcctttcaagacagctttgactccactcccctccatgactatcaagttttcatttctttgaccatcaaggagctcatgaacagttttggtcaaaggttatattgaaatcaagatgctgagtgcccaaagaatgttacaaatttactagcacaagtgccaaataaataagtgcattaataaaaaaaaataatagaactaagtaccaggccttatccaaccccatttttgtagagggctcaaactgctcacgtggaaattggcaactctagaaggttagggaaagagggtctccctgctcaactcagagacactaaatcaggagattaagtctccaagttgtctctggggctagagggaatgaataacagggtcctttatacgcatcttggatttctgctttttaaatgaaatccactgggccctatcagtctgtggtttgtctgctccgcttttagcaaactcgagatggggttgcgccgtgactggttagagcattttgcccttcagaagggggacccactgacccctgaccacagccttgtcatacagagagtgtcagaggcggtccaattacctaagaggactgagaaaaatcaaacagagctcgggcacaatgaggggaaaaaacacacagcaggcccagctttagctccactgcttgaattaccactatgtcaatagaaggtgataaatcaagggagatatttactgattaaaattacagactcctacgggaaactgtataaacagattgaagaacaaagcctgcagggactgagcccagccgaatccatccaggctttggccagtcgttcctgtttccagccaactcttggacccaggggtcactgagagagcaagttgctccacgaaacgcaggcttgctgtacacagatccaaatatttgtagggaaaatttaaaggcatgttgggaagagattcagggctcatacccattcacaaggaatcctcttatttcattcttctctttattttattattatttttttgcctttactctgaagtttggtctagactcactagaaagacccagaaagctgctctgtatactctacctgccagcagaggtgctgaggctacaaatacagaagggaggcggatataggagacgtgagtgggcacgaagccacgcccatcagaggttcaagaattgcatgtgtagccaatcaactttctatgccaatccactgtgtttaccctctctggggtgctcatgttggtgttcccaggggaaatgaatctctgctctgccaccctagtccctcagtgtgtatcacttgcttactgtcattctgctgctgttttttttttttgagacagaatctcactctatagcccaggctggagtgcagtggtgctatctcagctcactgcaacctccgcttcccgggttcaagcgattctcgtgcctcagcctcctgagtagctgggattacaggtgcgcaccaccacacccagctaatttttgcatttctagttgagacagggtttcaccattttggtcaggctggtctcaaacttatggcctcaaatgatccacccgccttggccgcccaaagtgctgggattacaggcgtgagccaccgcgcctggcccattgtgcttctttaaatggcattctccttgagtcagagaaataccttttgggaatgtcttggagtaatttgtgtaggcagggctttggaagcaaggctgcagctagtttttttgtttgtttgttttgttttgttttgttttgttttgttttgttttgagatggagtcttgctctgttgccaggctggagtgcagtggtataatctcggctcactgcaaccaccgactccctgcttcaagcgattctcctgcctcagcctcctgagtagctgggattacaggcacacgccagcatgcccagctaatttttgtatttttagtagagataaggtttctccatgttggtctccatctcctgacccactgatctgcctgcctcagcctccaaaagtactgggattacaggcatgagccaccatgcccagccagctgcagctagtttttagagccccatggatttcttcttgccagctctgtctgtgggattaggaccatcaccccaaaccactgtatcctgataaagggcagtataggtttatgtctcatgaatgggggaaactcacaaaaggctgtttaatgtcaccactggttccattattcatgagtagtctcggggttaaattttgcccttgtaacccaagttctatcccctcttcttgtgcccttgactgtgaatatacaatcatcacttaaagagaactgagcaaacgtgttctgggacaaatgagctttaatgattgggaggtgggagatgatcatctatgcaatgtcaagaaataacagaagtctgttggggatatagttcccgttagggctgctgtgtgtggttgggcgttctgtgaactatgtaaaggcaccagctgaaggcacaattgtgggctgaaagcagctgatgttctacctgccaatctgccatgcaagccctgactcagggtggcatccaccaagagggacaggtaactttttcttcacactgaggagaagttggttattcaagccagcagtccttcgggttttgtttactgagtgggagcactcttctctaattgttcctccagaggagggcagcttgtttcatatgatacaagggtacagaataggctagacaaggctcagaatcttctgaccttttcctcagagctgggaggaagttcaggtgaagaaaatcccaactagagcattcagaagctcatcctctaaaacagtagggagggccgggtgaggtggctcacgcctgtaatccaagcactttgggaggccaaggcgggcagatcacctgaggttgggagttcgagaccaccctggccgacacagtgaaaccccatctctactaaaaatacaaaacttagctgagtgtggtggcgcatgcctgtaatcccagctactcgggaggctgaggcatgagaatcgcttgaacctgggaggcagaggttgcagtgagccaagatcgtgccactgcattccagcccaggtggcagagagagactctgtcgcaaaacaaaacaaaaaaaacagtatggagatctcaaataactaaaaatagaactaccatccgatctagcaatcccactactgggtatctacccaaagggaaagaaatcgttacatcagaaaggcatgtgcattcatgtattaatcacagcactatccacaatagcaaagacatggaatcaacttaagtgttatccaatgaagaactggataaagaaaatgtgtgtatataccatggaataatattcagccatcagaagaatgaaatcatgtcttttgcagcaacatgaatagaactagaggccattatcctaactgaaatagctgaaaaacagaaagtccaatactgcatgctctcacttctaagtgagaactaaacaatgggtacccatggacatacagattacaatcacagacactggagactgcaaaaggcgggaggggggaggggtgaaaaattacctcttggggccgggcgtggtggctcacgcctgtaatcccagcactttggaaggccgaggtgggtggatcacctcaggtcaggagttcaagaccagcctgaccaatatggtgaaaccccatctctactaaaaatacaaaatttagcggggtgtggtggtgggcgcctgtagtcccagctactcgggaggctgagacaggagaattgcttgaacccaggaagcagaggttgcagtgagccaagatcgtgccactgcactccagcctgggcaacagagtaagactccgtctaaaacaaaacaaaaaaaattacctcttaggtacaatgttcactatttgggtgatgcggacactaaaagccagacttcatcactgtgtgatatatgcatgtaggaagcctgcatgtgtaccctctaaatatataaaaatgcaaaaaataaaaataaaaaaagatagacgttcaccctttgccttttaaaaggcagcagtggataataaaatgtctggagaatgatcctggcttgctctctggtccttttgcaactggattactgtaaagtgaggtgggtgtttctttgtgttttccccctgaaggggtccatccaatgttccctgtctgagtgactgaactccttgttcacggctgtcactgaacccatctctctccatcagcctctggagatggttggggctacagcccagacttcacacgctgtcttacgtttgggaaaactctgcgctatcctttattactttttttcctaaaggaagttatgtttatagctgctgcgcctgactgctctgccctctgtgagcctcctctgaatggtttccagggtgcgtccttatctgtgagcggaagtgcgttttggagatggggagaaattaatgacgatttcgggagctgggaaggtgaggtcggctcctgcgaaccgtgggggcgctctgatctcgttcttatgctctgcttgctgaaaaaatctctctttgccctggaatatcatggcctggagccctttaaattaaaaacagttgtgaaactggcagcaatttagaacttttgccagcgcatgaatctgtaaagagcagggcctcagggatgcggaccatgtgtctctaaagaagaggcctggtctgtgtccttggctttgagcaccccaggcttttggtctactgcgtcttttctctcctagaggtatatgggctctttcgggttgtgaccagaccctcccttctgacctcaccatctaccctgtcccacctccaggggtgctagggcttgccacgtggctcagtggtgtcaccagtgtttcctccagtcagtgatggatgcgtccaggcaggggcccacacctctactttcagagtgatcaagagacagcaatgcagccacctgcagacctttgcagccaatgtgaatccaagcgagggtttcatggaagacatttttgtcagttttcaggagaaggcagtggaagtggaaatgccagacagacaataaaatagtgaggtgaggatgagccagtaaaattccttctttgtgtttatggcttggctgcttctaagccaggaggtgctctgccactgcccaagtggggatttatttcaaatgggctcagccagagggaaaggcaggtcgtgagcctgtggggcaggtggagagtcaaaatctcgactcttcctgggaaaaaccttcctagggacactctccctagcattccggccaccccagtgtggggttcttgcttgcagggtcctagaacatccttgattgcctggcatctttaattaaaagtgaaatccatttgcaaggatgaggaggcccaaggattcaatgtcagtgaaaccctatttgggagaaaaaaaatgtcaaacgtaaacctgaaaacataattgttcccttaatgaaattcagagtgaatttcaattttgacctgaaattcaacaggttatcctgagaaacattcattgattatctcccgtgtgtgaaagtaggaaccaggctggtgagatcggcagggccggtgcacagcagatattgtgtgcaaagttaaggaacatgcaccatctcttttttttttttttctgagacagcgtctcagtcacccaggctggagtgtagtgctatcatcatagctcactgcagccttgacttcctatgctcaagtgatcctcctgcctcagcctccctggtagctgggactacatgtaccatctcttataggcagtcaatattttaaagaagggacgacctgagcagagctgtgctttataagagccatattagaatgatgttgagggcataggtgatggctaatatttcttgaacacctactatgtgccgggaagtgggttgtcttattatatgcagtctcttttaaaatccccatgtaaccgtatgaggtaagcattattcctgtcctcattttaccaaatggcaacctgaggttcagggaggttgagacatttgtccaacgttgcacagcttgcaagtggcagagcaaagggcggaacccaagtctaactgagtcaagagcccacactcttaactactatagatcaagcttaatatatacagtgtttgctttatcaaggagtaagcaagtatcccccaaaagctattccttttgtgtggaatgggcaaacctctggatttgagagcgtgagactcagaggttggggctgtcagttttagcacataaaaatgcaaaactgactcccagttaaatttgaagaattgctctaatgaatttttgtaatgtattaaaaatagctgaatgcaggacaatttgggcattttgacaaagtgaataatgacacgagatgaaattattaaggacaggacacgacttgtacacatgggccccctagatccccagccacaggggtccccaatccccgggccacggaccagtactggtccatggcctgtcaggagccggatcacacagcaggaggtaagtggtgcgcacgcaagtgaagcttcatctgtgtttacagctgctccctatccctctcattaccaccttagctctgcctcccgtcagatcagcagcggcatgagattctcataggagcgcaaacccttttgggaactgcatatgcgagggatctaggttgcgcactccctgtgagaatctaatgcctgatgatctgtcactgtctcccatcacccccacatgggaccatctagttgcaagaaaacaagctcagggctcccactgattctacatgatagtaagttgtataattcattatatgttacaatgtaattataatagaaataaagtgcacaataaatggaacatgcttgaatcaccccgaagccatgccccctcaccatctgtggaaaaactgccttccatgaaactggtccctggtgccaaaaagatttgggactgctgccctaccaggtgtgtaccttgggtctgtcacaccttaggctgtgtgatcgtgaatagaacccccctcacctagctcactctctgtaactgcaaaatatggacaatagcatttgcctcgtagagttattagagggtgaactgagacgacataaaatacccagtagtgtgcaaggtatatagtaggtactcaagaaacactttgtggatataccagccaattccctagtttccaggaaaagttttttttttttttttcactcaaaacacttaactcctattgagtgttttatgcatcaaagaacttggccttttcttcatgaaaaacatatcttttaatgggggtcgcatttcgatgtttcatccatcctatatttaaaaacaccagccatttctcctaacgataaagttgttacacaagttaaaaaaaatagggcaacagaaacaatgcccattatattattgtcaagcctttattatgtaggtattaaatttgacctcagaggtcatcactcttggaaaatgtttccatctgtagcactccattctccattctgttggttcaattaagcctaagaatttaaattatctctctaactctaaaaatatgtacagatactactgaaacgggaaactatttcagggcttagaagaaattctgtaggagtgaatgtgctcacagctttcaggccagaaaggttgacccttccagatctttcaaaggttgtggaaagactgtggaaatcaaatcaaatcaagtcaaaatagacaggctttctctcaagaagagggtttggaagagaggcggggggatggacaagttgtatgtctcacacacacacacacacacacacacacactcactcagtgggaaatgtgtttgtctaaaaacattaaattaacaacttctttgagtgacagcatttcttcctttctttctcttatttccagttcattcttatcagaattctgtcagctctcaagctgacattttcctgttctgatcttttctcagatagtaaagagggatttttttttttttaaattgggctgatgcaaacagcagatcagcctacagagaaacgtcaaggacagtttgtagtcctaatccctgacccccctgccctctcctaactagctattgacattgaacttaaaaaaactgcaatgccgagatgagataatgttttagaggaaagagaaaaggagtgtggtgagactcctgtggcagatgggggcatttcagaagtgaatgtgctgctggcctgtgagttaaacttcaggcttttcaaagttcagttttgcttaaagtatctggtaaagaaaacgggtctcatcctctagaccagaaatggagcaggcgagtctctttggatgacagcgatttgccctctttgggtgatcctggctttgttcacgtgaagtggtgacactttcatgatgcttggtgtagagaaactgttggcgtggtttctacattggacaaagcactccttttcacgtcacccacgttgcataacagagctgggctttataatgcaaaagtttggaacttttttttttgagacggagtctcgctctgtcgcccaggctggagtgcaatggcgtgatctcggctcactgcaagctccgcctcccaggttcatgccattctcctgccttagtttcccaagtagtagctgggactacaggcgcctgccaccacgcctggctaattttttgtatttttagtggagacggggtttcactctgttagccaggatggtcttgatctcctgaccttgtgatccgcctgcctcggcctcccaaagtgcagggattacaggcatgagccactgtgcccggccaggtttggaatttttaacagggatatctttattattattattttccttttaagagacagggtctggctctgtcacccaggctggagtgcagtgacacaatcttaccttactgcagcctctaactcctgggctgcagcgatcctccggcctcggcctcccaaagcactgcgattacaggcatgagtcaccaggcctagcccttaaaaggggtccctaaagggacttttgcagccatttcaaaatagagaaggagaaagaaccttgccaatactctgtttggacccctttgtcctctcgagctgatgagcttcggtccaccttcctgtgaagacactctcacctgagatggtgaatttgacttgcttcctctctagtggggaaacagggacaaagagagaaatagttttttcagaaaaccctgactaaactattgtgaagtcacctgcccttattttcctatcacttggtcctgcatgttgtagaataaagccctggcatctctgaaaatatttccgctattttgctactgttggaaaggtggctttgttgactggtgaccaaaccagaagaaaacctgagagagaaaatgttagattcccaggggtaggatttgtttagtttcagaacaaatcctgaaacacttaggttctcactttttcccctatggctatttacagggaggctagcgtctggatatttctttttctttttttttttttttgagatggagtcttgctcttttgcccaggctggagtgcagtggcgtggtcttggctcactacaacctccgcctcctgggttcaagcgattctcctgcctcagcctcccaagtagctgggattacaggcgcaagctaccacgcctggctactttttgtatttttagtaaagacaggatttcaccatattggccaggctggtctcgatctcttgaccttgtgatccacccagttcagcctcccaaagtgctgggattacaggcatgagccaccgcgcccgcccacatctgggtatttctaagaggcagtatgttatcctgcttaacataaaagggtgaagacattctccaacgtctctaccttctagaagctgctgggccacaccccggggattccaaaccctttccgggcatgccaaaggccagtgagcagctagcagaattctaatcacgtgatcattgttcactggggtcggcagatgccactgtcattgcttcctttacgtttattgcttgagacacttgaaattaggcctgacatagcaataacaaatgtactacagggaacgagccggcactggaccctagggaatgatctagaagacttaataggtcttttccgtctttaatttccatggttctaaatatgccggctgcttataaagcagaagattgattctgaggcagactggttagttttggaagcagtgagtggagaggattttgctttttgcagccatgttccttgatgcccactttaggctggatgtggtttctgagggcagccctggcatctctcctttcacctctctttggtagggagcaaatggggaaggagttgtcttgggcattccccctgagctcaccaacaaggtatgagcatctccgtgtaccgggaactcctccttgtctgtatggtgaaagtgtaaggactgggcaggcatggtggctcatgcctgtaatcctagtgctttaggaggctgaggcaggagggtcacctgagcccaggagttcaagaccagcctgggcaacatagggagaccctcatctctaaaaaaattaaaaaaaaaattaaaaactaaaagtctaaagacacacaattgagaaatggaggtgatgttatgggctcaccaacatctcacatccactcttgaaagaagccaagtgctcagcgtcagtggtgagcctccctaggaagaagtctttttgtttcttcataagatagagtgagcatcttgaccactccttatctgaggccaagggactaagactcaccttaaggaacgcacctttggaagcaggaagctgctgacatgtgtaatggtgtgacttcgtattacacagctggtgaattcattttggaagtggctgtgtgggggaagaagttgctgtttttcctttggtaattgttcccattggcttcgcccacccccatccccactatgatgcaaggaaacaattataggaataaaaaagacacagctaagtttagagagaatggggacaggcactaggagtttccaagttttctttgagctcacacatagattgcctttttctggacatgggaaagaagaacaatttcagtttttccagccataaaacagggaacttaatgattgcttgcatcatagaaaatgttataaggacaaactagcttacatttttacactggcctgcagacacactctattacataagtgaagaggatctttcatgacagtgaaggtgtgcgtaagaaggggacccaggcatctgttcacttttctgtctccatttccagggtgagatacacagctggaaaagctacttgttgtggctgatgaaatgccagcactgatatcatgctttgaaccgttttatccggatttaaggagccagtttccaattaatcagactccaaggtcactcaccgaaccagtgtctcaggtagaggaggattatgtgtgggggagagcagagtggggacatgagggactacagggcgaaggaagaaaagggagaaggatagagaccagggtgaagagggactggatttttttttttttgtaaattgccggaatttgaaataatcattggttaggggaaacgtgttggcttactaaaaaccctttttagtttgctaccccctaaaaatgggaccaaatccatggctgaaaaggatcctgctttcctggtggctgtgtggtggctctgcccagcctgatgtcatattcagaggcgtgggagaggcagagcccctcctgcaggagctgtttcatcaggattctgtgggctttctatgcaacccctcttaaaaatctgaaaatgaaacaagacatatttctgaggttgtcagcaggtagatccactggtttgtggtaagtaatctctctgggaggaagtcttggctctgatgtctgtgttgaacgttccgtggctccccccggccgccccagcacaggtctgttcgctgggcaaggaggcggtgatgatattgcttctaacaaccagactgaagcgtagcctcaggctgtcttgcaaagccccttccaaactgcctctaattaatttttatcctgccatcccaatgagtcccgggggtacaacaacccaacaacagaaaaaccctcatcaagtcatttggagaaagctttgacgtaacgcttgcagattttagatctccaaaagaggaaatgctgcagaaaaacaaaaaaccaaaccaaacccctcccgtttggtcacctccatcctactcgatttttccccccagattctcaccttttctttacagtggcagtaagtctgatctctctctggtcccctctcacccacggctctttcagagacaatacagagctgtatttcttttttttttctgcgggaagacaaccctgaattccctgtggtctggggtcaggtacctgcactgggctgccctgggaatctcttaaaagaggggaaggagaaaagctggcctctctggcttgtagccgcggtggggccaggcctcctcatgctgtgcaaacacgctttagtggacatatgttgggagcagagggaaggttccacaaagaggaatctgacccaccaaacacatcaaacatgcagcaccctgggcctcccccgttagaagtgctgctggcagcagctcagtcgccctacttggctgtgtggtggggggttcacgcaaaactattcaggttgcttttcttcttattccgaggggatctggggacagaggggtgccttcctccctggcactagcacatgagcctcacttgctaccttccctccagctctggaagtctcagcccctgggatcagatgtccactgatctcctccccaaacaccctatcccaccgccgttgcaaagccctccctgcccctctgcgtctgttcaggatgcttctcttaggaccttggaatgaatgaaaatttaggaagagtgactgtttgaaatgaggcattgagaggtgctgaaacccaaaccacccgccgccctggcttcctgggatttctggacaaaaaaggttgagtgacttctcccctccccgggacacaacagaggagagtgatccggtgccagcggccctggtgttaatttcatgatcaccgggtgccaaagaaagttactcaggatccgctggactcgacagctcctgagaaatggagtctttgtttctaatgcgtctgagctgtctggctcctttaaaagagttaatcacagaatcacaggcctagaaaaagacttcttggatggctcctctgtgctaggtccaagtgagtgagggctgatcctgtttttgaagaagcccgtggagcaccactccagtgactaatcgctcgtaattgtcctcgttaattttaacctcatgcgctggtgctttaagcagatttccatttgtccgtcctcagagaaggtggaaggcattgctcatcgcacaaatggggtcattcatttccttccctctcctttttcttgtctccttgggcgatcgactggcccaacagggaagagcaaatggtggggagctggacacaagtgggtctaaagtctgcaacttcctaactatgctgctaagcctcagtttccctgtctgtgaaactggaggaataatagccacctcattgggttgttttgaggattaaatgaaataatggaaggaaagtgctttgcgtgggttcagggtgatgcctcctacaggctcacaaacaaaaatgtgccctctgcaggaaaggtggatgcacgtggaattcctgcttttcggggtaccctgttcttcagtgccaagtgatattggtggatgagacagcaaagagcagtggaaagagaattgttactgggggcctgaagatgtgggtcctattcacagctctgctataacctagtcttgtgaccctcactcaggaaggcaccacctctctgggcctcagttttctagcctgtaacataatctccaccctgtctgctttgcaggggagttggggagcaactgaggaaaggagagatgggggcggtgaactgccaacagaaagtgctagtcaaatgtcaggtgtgaagagtcctgaaggtcgatgctcaaccagctctgctgctgcccctggcattttccctggcaccaaggaacatgttgacagtttgctgggatccccctgaatttccagtatcctgggggtaaggactggagtgaagcaagttaaggtatatattatctgactcactttgtagggttcacagttccttagaccctcagttctggtttgttttgaaaggggacaacccctgtctgggaggagcctttagtcaagaggcagtactgcatagtggtgaagcagtttgttaaaccccacagactatggggccagaccctggtcatattctaactctgccactttccctcctatgtccttgggaagccgcctgcctctctgtgtttcagcatcctcagctgtacagtggggataataggaattcccatctgataaggattgtgtaagtatgcaccacatgcttaaaccatgccctggcacatggtatacactcaagatgtagtgacagtataatcgtcatgagtcaaatgtttgtggtccatgcagtgatgaagcctgattcgtttctgaaagacctcgctaggaccctctagtccagtgggttcttaagcttctgagggccacggcttgtatgacaaatgttatgaactttctctgctgaagagttaacatatgcccctaaacttcacatatatcttcagggtgttccaacccatccatggaattgctggggttcatagaccccggtttaggaacttcttttttattttattttattgccttcctttattttgtttatttattttgagacagggtctcattttgtcacccaggctggagtgcagtggtgcgatcatggctcactgcagcctcgacctcccaggctcaagcaatcctcccaccacagcctccagagtagctggcactataggcgtgcaccaccacccccagctaatttttgtattttcagtacagatggggtttcaccatgttatccaggctggtctcaaactcctgggctcaagtgatcctcccaccttggcctcccaaagtgctgggattacaggcatgagccactgcatccaaccttattgccttcttacttgctaggtcaccaggatcatccaagtacagttttggatatagtaaggaaaagtatctggtataataaaattatattatggttacgtcaactagaggtccaaaaaagaaagaaaatgtatgatataattgaacccaagctaggcttcataaatctttttcttgagtggtatgcctttgatgcatgtcattgcaatttttgtccacacccaattcacactgctctgagagaatcctggagaaactttctctttgcctctatttccatggcaattgtgaatagccaagagtcactttgttaagaattcctaattctggagaaatggaaggtcaaagtcatgaacctctcagttaatagtggaagtttccttattttaagttttatgaagaactctcttaagtatggtgtttataggctagggtttgcaagaacctgaatcaaaaaacaaataatagcaaacatacccttcgctaggattctacctggatgacctcattataatttggtaggaattaagggttagacccacaagagtttcattttcaggttagacagaagcatatttcaagtctctccaaatacctacttaacaaataccaccttttgcatgttcttgatttatttctctacttctataccattggctttgcaaaattaatttgccacatggaaatttcttaaatcactttctcaccaaaccatgaatatggtttggaaaagggagaaggggaggaccctttgttttttctattaagggctgataacccacaggaaaaactgattttttccgaaaaaatcaaatatctgcattttcttttcttagggaaacaaatacctgtttggaaaattaagtacagagaagatacagaaatactacaaaatatggttgtgtctttactatttttttttttttttttttttttgagatggagtcttgctctgtcacccaggctggactgcagtggtgtgatctgggctcactacaacctccgccacctgggttcaagtgattcttctgcctcagcctcccgagcagctgggactacaggcatgcaccaccacacccagctagtttttgtatttttagtagagacggggtttcaccatattggccaggctggtcctgaattcctgaccttgtgatccatctgccttggcctttcaaagtgctgggattacaggcgtgagccaccacgcctggcctgtgtctttactattatatccaatttaagtggctagaaagcaaaaaaaataggacaggtaaaggttggtgaaggggaatcaggaacggcaggaagtgctagagagagtgaggggcctgactgaacaggtgggagagaagcggtggttgcagaagagatggatttgggtcaggcagttacaccaatggtgcagagaggaaagataatgtagcaaccactagttaccatctttatacgtgtatatctttgtatctccctcattgcctaacacacatgccgtgtacatattaggtactcagtaagttaatgaaacagaaacaaagagaatgtgtaaaacaccagaagctgtaaaattaattttgacttagaagtgtactttatctaggctgtgatcttaccattattatcaagtgccatctgtttctcttgaaatagtttttttttttttttggaggggggatgggtgggggttggtgcagtttaattgctcttcacaggtcttcaactgctttaattaatcccaagcttcagaagctctaccccgaatgggatatctagagcttcctccttggggtggtggggagggccagattttcctcaagactgcaataggagtgcgcagaaatcatatcacagtgagcttgggagctccctgtggacttgggttagcaatttcccatcctgatggctacggacttcgatacagcctagtgacgccatatttgtagatcatagacaactgcttacatttcttctctgaaaaataattctgaactggggcttgaaaacatagagttgagaaacaaaggacaagggaaacattaattttgtgcttaacactcaacagtagtgtccatcctggccagaaaaaaaaaaaaagtgttctcctggtttgagagaatctggctttagcagaacatctgagttggaatcccatgtagctatggaatgaaaatgtgccatatttgaatgactggtctgtccactccttataatgacatctagcccaaataatagacccatacgtgtaggtggcacttaaaaaataccattcaccagaaggaggttttgagaggactctacctcactatttcagccatgcttgaaataactgcaaatggtcccatgccacatgaaaggcactaagtggcattccttggatgagcagggagcccaggactcttgatggtaggcgttctggagggccatggagctgggacactggtattgacatggtgacccctagtgtttcctgttggtagcacgacttggaacaccaccagcaaccctggcctaagtagggcgtctttaccatcttctgatggaaggagttattgcccaccataattgtttatgtctttaaaaccatcatgttaaacaatcccccccttcaactttaatgcatttttctgcacaatatccacttctaacccctgctgaatagaactgagtcttgacactgttgttttcttataatgtgtggcctcctgtctaagcatttcaaagatcaagatatatcaattcattactgtggttacaatgtcataaacaatggataatggcatcaatggatgaattgttggaggaggtgggtattgctatatccacggcatgagagcgtgactaggaaggatttactatgagcacatgaagtagaggacaagctagcaaggtggatatggtgattggtccaagtaccatgtctgttgtctgttgtatttttcatctcagtaccctgctccagacattgtagcaaatgatgagtaaacataaagcaattggattgtatatgctcatgcaaggaggtgaggaaagtcaactaagcggataattcaaaccacctaaaccacttccccatgacttatctggatatttcagagaaaagtattttctttttgggatttgatcatgtgtatttctactaaacatgatagatgtcttcatttctaatgttacatactataggcagacacagcctgagggtaaaaaacaatgattacaactcattcattcattatcacaaaccttacttgacatagactaagtgggctgggaatgggctggccgttggttcaaatcccagtgcttttcagtttatggttattaccctgttttatttcaggtataaaagatgcttcttgtcagtgttccaaatgtacttgggtgtcggtaaagaaaaagaagataagtagagtatctgatttggtggtttttttttttttttttttttttttttttttgagatggagtattgctctgtcgccaaggctggagtgcagtggcacgatctcggctcactgcaacctctgcctcccaggttcaagtgattctcctgcctcagcctcctgagtagctgggactacaggcgcgtgctgccatgaccggctaattttttgtatttttagtagaggtggggtttcactgtgttagccaggatggtctccatcttctgacctagtgatccgcccgcctcaggctcccaaagtgttaagattacaggtgtgagccaccatgcccagccccttatttggtgtttgaagaatcatgtcaccgttatcacaaagactgtaagtcttttaactgcatgaataccattggttactttattctcttccatgctggtatctttttttttttttttttgaagtttaaccccattgctggacataccagtgttatgaagaagaaaataaactaaaaaatgcttattttatgcagaaaggtataattctgattaatagtaataaatcaaaataaatcggtagaatttctaagactcaagtgagagcttggggttcttctctagctttcgttgattatcgagaaacaaaggccagaaactgcatgtaaaacaaagaggcacaaaaggcaaatgtaatcccatcatttagatgagttcttgggtgacatctttgtggtttccttttcctatatctagacctccagattcagttggtggctcatcctcgctacagaaacttccttaatatgccagagggacatgttggaagcgaagggcttctgtcatcattgggaagggcagaaacaaaaggggactttcactcagatgcaggagggaagcaagttctcccaggcaaagccaacggcactggattctttcccccaacctacttgttatattcaaatacttcagactctcctttttataaaaaatcagttctgccttctcaaagcaaaccatcaacatcaaaaacaatgacattggatgtcattttaaatgaaaaagaaaaagaaataaacagattcaaatgtgagctcggggactctcgactttgtgaacgtcccgttcaaaacaaagctctttgactattaggctgagaccagagagttttaccttccaggtgtatatttctagagtcatctgtgaattggggggaaactttggaaactgatgtccaggttcaactataccatcaaattctggagaagattgctaacgtatgatcagaaaggaagaagacggtttgtgtagacaacgtggctggtccctcgtagaatggggcgtaacggggtacacttaggtatccagagtacagaaaacctgctgacaggtagacacctaaggtgacaaagaaattgccatatttattgctttagtgggataaaatgcatggttgtctaaaatgaaacggtagcaccaagtccatggcccatgaaagtgactctgctgccatctatgcccaaagcctcttgtttccaaggaagccggttttataggaatgcatcagaacatcttcttttaccttttgacaaaatgaaactgcgtccttgggagtttcccacccattgctctcttggctacttcactccagtactatttcattacttattgatttttcaacgcctctctgcatggctgtaatttacacaagtccttacagcccttagcgattcttaacacctcaaggtaagatcactgagtccactagagagagacattcttttctggaatgatgaaaaattggtgagtctccttgctaacacaggctcctttgggaggccatggtggatggaaagtaacatcacagtcctccaggtgctacagtgagagggtgaacgaggccaactccaaaatggatgttgtcacattcttgttatgctactgaagtctatgcaacttttatttccagaatgaaatacagagttttatagattggcagttcttagtgaaaaaaaagaaagcctatgaagtaacctgaaagctggtaacattggatttattatgatcttttaaaaaattaatcaccacactagtcaatttgtaaaatatgtgtttgcctttgttgtaatcaaggttccacatggaaaaaagaaatggaagtaaaggaaaatgtcagcatgatgaaaaaacatagaagaaaataagtgtcttctggagagtttttgagtaaaacataccagtgttatgaagaagaataaaaactaaaaaatgaatatcttatgcagaaaggtataattctgattaatagtagtaaatcgtattaaattggtggaatttctaaagtctcctatccagacttcattatttggccttcaaaagtttataattaaaaaaattactcagctattttgctatatattactaggaaatattttttgtttcagccataaaaccccttcatgaatttttattttatatatttagaattatggtgagaatgtgatttatacatttgaaggaaaatttaatattatcgaataatcatatgaaaaatgatatcttttcaaccaaagataggattgaattctcttgatgcttccactacaaaatgatattaaataaaagatcccttgaagaagtgtattttagattggccctgtgaggaagccatagtctgaaaaaaccgataaatgtcagactgtttacacagtatcatgtagcttacctaactctatgacctgaaaaccatttctggatgcttccaaaacaatgaacctaaccaattcacaaatcacagactttttttttaagcttaaagtgaatttagaaagcatctggaccaattatagttaatttgttgaaatcagggaaaataatcctatcaaaggagctatttagcatttgaatattttttaaaagccaattttttgatgacatactttactttttaattatgtattacctgttacgctcatgattattcatccttcacctgatgtaaaccacccaattttccaatgccttgggacgtactgagataattgtaatgaacatggtgcttgcttgctctgtattgcttccctttcttttgaaatgtgcactctaaatttcttttatggggaagcacctttccctgctctcagttcatttggtttgggcagggcagaccctactccctggctctaggttgatccaagccaggccagctggacactacaccaccttgtctacagtgatggacatgagctgagacagtgagagccaaagcaagatcttttgctgaaaccattggcaatgggggggctctgtccccttggggtatttatgctggtggatgtgagtttgggctgccaggggctaccacatgccaatagcccacctggaaatgaggcaaacacagaggaaaacagaaccaaagtaggtgtggggagagtaggggagtcagatattactgtttgagctgttgaatccagctaagcctaaagcagccaaccccatgcattttagtctatgaattaaaacactgccatttttacttaagctaatgtgaatctggttacagttagtttcaacccaaagaggcttgattaattaggacaattttatctgtgaacaatctgcatgtttcaaacttattctgaaataaatttggaatgcttaggcaggttcactaaattaaaagggcttcaacaattttgttgtccatgtgagaggaaaatgctgcaaaagcatcttagacttggctgtgcaactgctttggtatgagaaacgctctactagagcaagaagagagaagctgaaaaatccttaaaaataataatgaagatgaagattcactatttttgtttcgttttggttcaggtaatgctgaattacatgaaatctccttaagaatagtcactgtattttcttagcatctgcaataccaaacaaagagctagaagcacagtaggcatttactggactaaacttattagaaagaattgctgcctgtccttcatgcttcctacatattgatgaatgaaagccacttacggcgtggtagtgtttctcaggaatttaacacaatccacaaatgatcagacttctctgaagattgacaaaattcccagaaaacaccaagaacataaatcagtgggaagaacatttttttttaactgtgactcacaatcattttcttaaaaaaggcatttaaatgtaaagatctcagctcaatattattcactataagtctgtgtagccaaccacccattctttgtccctgggtgatgtgtaagagtactgcccttgttagaattcataaatgtggccaaaacctgggctagactcaatatttctgagcccttgaaactctctagaatgaacaccattaaaagaatgtgttcattttgaatcacccatctcttagttatttcctaaccatctctttctgaaattaactgttggccaaaatagaataccaatcaaaagccacatggaagagaaatatgaagcctgagaagaaaatatgaacctcacccagggtgaatagctcaaagagtttctgtactaaggcagcccagccatatggccagtttggcccagaatcaaaatcaaagttgtaaaaccatcgctatggcaggggaagatgttcgggctgctggagtcgaaatgactacactgtaatgctgagactgggccaaccagatggtgctgagggaaccagacaggaattccacagcaggaagatggacttcggccccagtctagctttccaggctcacctctctgctaccctctgctccagccacactccactgctcgttggccttctttcatgtgatgcacttttcacatctctttgcctttgattttgcaggtccttctctctggaacgaccacctcctttgctctcctccacccccatcaaagtcatgaccatcccacccaccttactgtgcttttatccccagccctcctgcacactctgaactacctggggtgccacaaggcttcatctttctttctttcttttttttttttttttttttgcctccacgccttgacataacttttttttttctttttcgttcctatcttctaccctcttcttgatcttcccagcctagtcttctaaatttagctgaagcatcacctcctcctggaagccttccctgatctctccttttaatttaggagaccctcccccatgctcacacagcctcttggtgcctattttatcagcatctactccgtcgtccaggagtcactgacccacacgtgtatctcttccatatgcctggaatggccttgagggtcgagactatgcatcaactgactttgcattccttttgcttactgccaggcactcagtaggaagggtgggtggagagataaatggctggaaggaaggaaggatgacttaatccttcaaggccctgctttcatgtcacttcctctagaaagttccatggcccatccagtcctcttgtactttacatacagacattattttttaaaattcccacaatttgacttgcattatggataggccctgcttctctctttcaatagagcgtaagctctctgaggtcagaattcaatctccatctttatatccctaatgatgccttgttcctagtgggtgcatatttgtttctgttccataaacatttatggaaaattatttggtaccattaggccagaaaacatgtgaaaaccattcaaacaaattctgagctggacaggagactcttcctagctttggatatttaaaaagctggtccatctaacctgagctgggtgggctggggataggtgaatgctcatagtaataatactagctaacacttactgagcacttactgcagtatataggctgtactaagagacttatgtgtatcaaatcactaatttacaaatgctcagtggtacctgggcatgactcccatttgagccagtgacaattgtccatctatacctcaggggagagagttgggtctggtgagtttcagactggtatatgaaagctggaattgttctaagaattagcagagagcttcatcaattgctgtctgcctgcacttgagtatgttaagccaaaattactttgaactctgttaacctatgattttacaacttgaatggaaaagattcctctccgaatttcaagattttttttttagtaaataaacagttggtttttagacaggaaagaaagacaattgaggtggttttctccactgcagtggtccccaacttttttggcatcagggactggtttcatgaaagacagtttttccacggactatgggtcgggggtagggggaatggtttggggatgaatcaagcgcattacatttactgtgcactttatttctattattattatagaaattattatttctattattattatattcattataatatataatgaaataattatacaactcaccaaaatgtaggttcaatgggagctctgagcttgttttcctgcaactagcgggtaatgggagacagtgacagatcatcaggcattagattctcacaagaagtgcccaacctagatccctcgcaagtgcagttcacaatagggtttgtgctcctgtgagaatctaatgtcactgctcttgtgacaggaggcggagcccagtggtaatgcgagtgacggggaatggctgtaaatacagatgaagctttgcttgctcacctgccactcacctcctgctgtgtgacctggttcctaacaggccatggactggtaccagtccctgagggaaccctgctgtcttgggagctctataccccttgtatcaggaaccttccaccttgcaaggatatagtgcagattaaacacagcaaagagcataaatagcctagcacaacacttggatggggagctgttgctagttgaaccttcacaataacctcagcagggtagtcacggctttcctcattttaaagaggttgaaagtgctacaaaaggagttaggcaacttgcccatagtcgttgcatgagtagactgctgagtttggatttcaatccatgcttatctgagtctgtattaaccattaacttacaagggagcctaatcttactactactaaattgttttatgaccccaggaaggtgatttcctctctgggctgcagtgtttattgtggggtaagacactagcaagtggaataacgagtgtgggctgctcagagattcagagtcctaggactccaagtgaccctgattgatggtctggaccatactcttgagtgaagggctgagtcccaaaatgtaggtatctaatgcaatttcagaggcctctcgagaaagggtatatctaacccaccttgagatctcacagggttgttactagaaataactaataaaaaagcctaggacatgtccaagtgccacagtgacagatatgactatacataaattagtcttgcagaaagctacttgcctggggtcatcataaatttctgatggcgcaacacaagactgattgtatttacttttgctctctgttgggttcagaagtatgataggccagtaaaacgatttagttagctggtaaattatctgcaagattgattaaaaataggaagcgagcaattggcaaattgtcaatgcacagaaaaaagaatcctcaataacgagatccagagattaaattaatttaacatggggcaccatttgaggaggatgtttcattgaactcttgtgatattatttggactgaaatgaccgcgtgtggctgtgagtgtgtgtgtgtgcgtgaatgaagcagctttgtaacatggtgctcattttggctttcaattcaagattaggaaagcagtaaaaataatacacaagggacagcagtccttagcgctcatcattctaaaagagatcatttggtggaaattagaaagaaaacatcagccttgtaataaattactctgagtatcccaagaatggaaagctggcttctattgttccttcttctcataaatgatgtgcccagattataccatcactctaacatgattatgtatgcaaatgatgcagacagttatacaatttacaatttggctgaaattgttaaagaactggcaaatggactttgacaaatcgcaatttgaggttttaaaaatgaacttttatcacagagcaagaaaacaacggatattctgccgtgcttatgtaaattctttgggcaacatacaatagagatgcgattgactacattttaaaaactaccgtcaactctttcctgtggttgggaaatggataactcaaatattgctctggttgaatcaaagattgaattaatagggaattatcatatataccacacatggattaccaattttaaaagaattaggccaccagaaaatacatttaatttaatatttctttgatgagtcagagggcacttcaagatcttgctgtgcccccaggtcatcattatgaaccactattgatactggggaggcatgggagatagttaatgaagagatctggccaacacaacacaggaaaacagggagtctgctgttttagacatttatgtcagggtgtctccctttcaattttgatctctttatatccctagggaagcttagagttcgctactgcctttcttatctaggccagagcttggttacatcatagtaagatttctcaatattttctcattcagagattcatactggcatctgtagtcttctcctttatcaacatgtattcagtattttttttccaattaaatacatttacaaaaattctcccacccatttttctttttccccactacacatggccaccatctcgatatacaattaaacagaatgctcagaaaatatctatttgtaggccgggcatggtggctcatgcctgtaatcccagcactttgagaggccgaggcgggtggatcacttggggtcaggatttcaagaccagcctggccaacatggtgaaaccccatttctaataaaaatattaaaattatccgggtgtgatggcgggtacctgtagttgcagctacttgggaggctgaggtgggagaatcacttgaacctgagaggtggaggttgcagtgagctgagatcacgccactgcactccagcctgggtgacagagcgagaatccatctcaaaaataaataaataaataaataaataaataaataaatagaactaaaataaaataaaaaataaaaaaaagtacctatttatgcagaatggtaacaagggaattgactcagtccctgtactccaaggtttactatctcaaatatattgatgatcatttataaaggctgtcaagaacattcatgaaacttaaacccagaggaaagagccagcaagcactagacgacacacggttctagagcttcttgaccaattaaataagggcagtttcaagttcattcttctgttactgctcttttatgaagtaaacgttgttcactttcctcttaaattacagggcacaaaattagactgtggcggggtgtttaccaatgtaggatataatgagaaggctacctgtggtttcaacattctgtatttctagccagaaatatttttaacagtgaccagttggttcatttggttagtaaataggtaataataaagccaaaagaacgacagcagtaccccttgggccagttggcttcactcatttaataactagagtagacattaaggtttgactccagcacaagttagccatctagaaaataagtggctcactagagaggcgatatcagtggccagcaaataatatttgggaaaataattttgacatcagtaaaaatcagaatcatgcaaattaaaataagggaacattttgtccattaagttacttgggaaaagagaaggtgagggcagagaggagaggaaacagtcagtaataagtaacaataagtaagagacagagagaaaacccagtactggcctggagaagtgaaatagccactctaacatggcaggtgtaaattgcgccaacgttttggaagaaaaaaattggcaacagaagagccaaatgtatgtccgtgccctttgtctcagcttttctacttctgaggaatctatcctacagacttgtggaagctgtcattttcctccagaacattctctgcactatctcctagactttaacattaggagtggcgtttggatgacaaaagcctccaagagcaagctggatggttccatttttgagaaacaaggttcaaacaagcaagcaaacaacacacaaaaagcctctagtaaagaaaaaaagatttatgtctgccccaaaacgttcctagcaacattatttgtttttgaaaaagtataagcaatataataacagtgggatagttagcaaattatgttacatccatatgataaaatattattctgtaagaaactgatgtttgtgacaagttttccactgacacaatacatgtttctcatatgaaaaacagaacataaaaccatgtacacaatatatcatgggtgccaaacaacatgtgtagatggagaaaaatataccaacgtcataggcaggattataccagatggtgacaggaagagtgactgaattcttcacagttttctaaattttcaaagatttaaatgaaaataacatgttaattttcatagttggaaacatatttacatctttaaaaataaggaaatttaaacaaaatgagaaatgtttataaaatagcattaagtgacaaaagtaggagtcaagatggaaaggcacaatatgctcttatccaggcaaatatgcctgtaaaacagactgaaagtaatacactgctaagaatgctacataggtagctatctttggttggtaggattagagatgcctacttttctgtacttcccccaagccatgtattacttttataataggaaataatgaataaaatacttgggaaagaaaatgttattttgcaaaatgaatctagtgagagtgtgcagataaaacagtgaaagtctttttatcagtactgccccaaacaactttgaaatgccacgtggcagtaactcatctggtagattaataatatgtatcatccttttattgggttttgccaatgcaattgccattttttttgtaagcaaatcatggtcaaataatggcaatttcatacagttcaacccaatatatgaggaagaaatggccacttataaaattaattatcatactctctacttttatagcctcaaagccaaggccaaacaacacaaaaacaagagtttttgtttgcgtgagttatatctactaatatattagagattgaaatggagaaatattttaaaaattcatttaaaactaagcccattgcatgttaatataagtaatatatttcagtgaaaatgattgtatttcccaaataaaaataatttaggagaggaatagcattgtcttagtctgtttgtgctgctagaacagaataccatagcctgggtaatttatgaacaatagaatttttcccccatgggtctggagggtgggaagtccaaggtcaaggcgcctgcaggtctggtgtctggtgagagcctggtcactgcttacaagatgttgccttgaatgccgcatccttttatagaggagaggaatgctgttcctcacatggtagaagagcaaaagaaagcaaacccacttccacaagccctttttatagcaacattaatccatgaagcacttcccattaggtcccatctcccaacattgttgtgttgggagttaaatttcaacatgggttttggaggggacaaacattcaaactatagctggtattgttttgcatttttgtaaatctttggtttaacagaaggatgctagattctttgatctgctttgacattcaatcttttgcaatattatacatcatgtagcttctggaaaactccattgtacacttgtgagagaatgaaagtgaaaaaagcatataatacctttatgttaatatggaaattgtattgacttcagagaccacagaaacccagggtccccagaccacacgttgagagccaatcaatgttcatgactttttcagggtcatgggtccccaaaaagctatacatgttcttccttctctaagaaatgagcatgcacacatatgtacacacatttgtaaataactttgggggttcactaataccctgaagtttatggataccccagattaagaacttggcctggaaggaaggtaagaattattctggctatgtttgcatgctgaagttcccaggtcaagaccatgctcagttaaggtgcttgataaatactgtagcataaaatgaaataaaaatttctcagcaaaattagagaaatgtctaaaatcgccaaaagattaaataaaattaaatggtaaataactgctggatcgggttagctgtgctctaacactgagtcagcaaaatgcctccccatacaaacggcaagggataagggcaaactccatctttcacttctctcccgaacatcttttttcaaagaaactaactggctgcaattcaaagacagtttgaaaaaatataaatatatattttgggggtaaaaaaaatccattaaattttttgattgcattgagttgcttatcaagagtgtgtgaataatgccaggaaaagatacttttctaaaaatcaatacgttgaaagtgctgttttagggttgctgtagttgttggttgtgtttcagagttattcctattgacctgaattcaaaaacaaggtattgatttataaagtaccttcagtaaataaatgcacattctttcagctaaccctaataacctgtagcatacagaacaaggtttcaagtcagctctgcagaggtgagcttatagtgtcacaattaatcctctctcagagtcatgaggctcctctaacgtgggggaacaagagagatggcagacaagaaaaccacagaaagaggaaagaggcagaagcatcttagcttcttttttttttcccaaaagattttttcaaatgtcattttggtttcctgagcaggtgggatgcacagatagcaaaaccatagccttccaatgattgaatgatgactcatcatagtcttgtaaattatgtctctactcaactttcccattaagactgaatggtacagataagcaggaagatatctctttagttgactcttgggtccattctatagaaatagaggatgaggcccatgacccctggctttacattcaaagtccacatcaggacaatgtcgtgggttggttctgatctttctcactttgccattacttaccagccacaaatggttggttgatgaggaccatattgccttaaagccccccaactttcttcacaatcattttttaccaatggcaattgacttgcttctttaagaagcaggtgaatatcatgaaagcaagcttgagcaaagtgtggaaaaatagggtttctgggcactgggcttctttctggacttttcttgaagtcaatgcccaatgacacttgagagtgattattaagaggttatatgcttagttttgtcactcaaattttatcacttaaatgtatcaattcagataaatttatccattttttaaaaaaagaggcaaagcacagggtaatatagaaatgagcagaaatccaagagaagtaaaaatacaaagcacggggaaatatacctgtatcactaatgaaggcatcctgctagataccagtgaggctgctagatggagaaaacccctggtggagcctatttagtgtccacagtgcaggaactggcaaaattccatgcatttgtatttaaatcccaaagaatctatgtttttttttttttaaccaatcaagttttctgttctttctcttggttattatgattttgattatttaaatagatttattcctgcaaagcacattttttgggggctagcatgattctcctgcagtggttgagtggtgttttgtgaaccaggagtcttggggatggaatggcagggaggggggtggcaagtgagtagtgggcctcggcctcacacctggcttcaatcagcgcagttctatttgatctgtttttatatattgaggataggagtaagattttattagaaaaagaattttgctgctaaaaacaatgacaacgagaggttgaaagtcactgatctggggaaactatgtttagactgaaattgaccctgaacattaataattcttctgtaggaaatcagctggtgacttctctctctctctttttaaagaagtttcaagttatccatattcattattttaaaaagtacagagaaaacagataagcaaaaagaaaaaaaaaaaagcacccatcctaatcctactaccctgagatcacagctataaactttggtgacaacttattagcctgttttctttctgtgcatatatatctatacacccttttttaaataaaaaagagattaaaaactctacatactctagcacactgtttgtcacttgattttttaaatgtatattatgaacatatttccatgtcaatgaatatacctcgacttcatactttataaaggctgtgtagtatgttagcatgtagacttgatccatttctatcatacatccagtttatccattgcattctggtaagatatttattctgctatcataaacaatcctgctgtgaacattctagattgctatacagagcagagcttctaactgctgtgctctggcatactgatatgttgcaaatggtcacacgtgtgtggagatatggagccacctggatcatttgctgatctgcccccagctcatgaccgtcacctggagctgtgagctgtccctagtgtttacctcaatatactccacacatgtgcttgtctatgtgactcgtgactctaaaattcttgcagagtattgatacggagttggcattacaaatatgccctctgcagccagcccagcagactttgagtctcagggtcaccctctatcagctgggggatcttgggtaagtgacttttttgtgtgtgtccctcaatttcctcatttcttaagtggaagtaattataatatctgccttctagtaattgtattgtttaaaaagtgcatgcgtgtaaacccttcgaacaacgtcagaaacgcaggaagtaatcaagatgttaattattagtgtccttgactctttttgactatttccgagctgggatggtttctgatctgaaagacagaatgtgacctttgtccctgaagatctgtgtctctccatatggcgtaggacatagcttcccaaaaggtatgatgagagagggattctttagccctgaagatcatctggaaaggcctgagggatcagagcccctgggctgatagcacccagcctttgattactccagtgtgccaaacaaacagaatcacttttattgtgtgcaatgacttgagaaaggttgggaaacggggtcatgggctttgtgtttatttcagattttactttgacaccctgcctcaccaagttttcctttccttctcttttctctcaactgtaagcaccaattatttggcaaacaatcacaactaaccagaacttagctcgacccacatgtgcaaggagaaagagatcggttttcaatagtagtttgctgaggtaacttcaatagcattttgcaatataatatgataattaccactttttagggaaagaaaaacacgttaataatcctttacctacatctcatgtaactcttttgttttctaatacttggctggtccccgcagtttggggacattcagggggtaagtgcatgataataagaactacttactgctgaaacttgaaggtgtatttaaaacacgggtgatgcttttgtgaatagccatgttttctgtctttaattttagttgctgtttctcctagtcttgaggttttgaagtttctggctttctcctttatgggcccgggtcccatttttgctccagttgagtgcagatacatgtctcaaattctggctgaacatcagctgtcctctcagttttcagaagatggctctcctattccttccataagctgctttggtctttgttccccgctccaatctgtaagccatctgcaccctttattattaagaacatatttaccaagatttcacaactgtttaatagatacgtatcttattacatgtttgatacacctcattaaacatatgattcaatcggtatttatttaacatccagtaaacacggagacccctcagcctagatagggggaagggggaggaccccagctcagtgtcagtgtgcccctttgtcctatagaaactgctccgcacagcccagtgcttcatctttaacccttcaacactccagctcaaatgggcttgggccaagagtcaaagtcgggatgaaagcctaaactgtagcttacacacagttcaggctcccactggggctaccaggctggatgcagtccacgttctcctcatgccatctcagcaacagagccaagtgtgagctatggggtgccctgtatttccagccctacagtgtgactgtgaattttttttttcggtgacttacggtgtggccttcaatacaattcattgcaaaaaaaaggaggaagattccaaaatctcccagctgttctttcaaaccagactagatgcatcagagccctgttaaataaactagatatagaccaggatgctctctgagtctatccctctgcttcgttcttcacttgtctaatcttcatgacccttgattcatggtgttgacctcttcacacatatcccagacatctgagttcacttcccatgtgctcgagatctcttagtggtttcagttatgatacacctgagtactacatggggggaagctcaagacagaaaatacaactcaacacaagagcctttcttcaaatggaaattttctggcatgagtttctcatccctgccagcttcactttcttctaaagcagggctttggagaaacattactccattgaaatgctgaaggcctttttttttttttttttttttttttctgttgttcagggtttccaggattcagggtgaagaaatccaaagaaaccacaccaactcctctgtgggaaaacttttcctttaagaaggccacaaggcttagccaaacaactgattacaaagtatggaactgcaatgctttctgtagagggggcagggggcaatttagttcttagttctttgccataaataacggattaaaaagcttagctgatgctataaattaaaaatgtgaaactaattataccagtcccataaaagcaaaacaaccaattcataaccaaagtatgtgatgtgacagcatctactgggtatgacagctctagagaagccgaggagacccagtaatcctgcaagaatctgtcctccagcccagaaccacaggcctacttccatgttacaaagcaaaacagtagtagctatgttgttctctctacccatttttcatgacaatggcttcatcctttctccaccccttccatgcaggcccattactcaaaagaaaggctcacccataccaaaaagcacagctgcagttttgccaattcaaaccagatgggtctgaaaggcagctgctgccaagactataattcaactgggagttcctaaatgtttcaaccagccatttaataatgttctatctggagttttctccctgttctaaatatatgagtgaggccaacttggtaggaccctgcagtttcagaagagttctctgtgttgctcaatggattgtttccttctgtttgacatggccccatactcaacgtatcacaaactgctgtgttttctccacccctagcttgtcctccccccgatgctgaatgaatcactgttcacaactgatcatgtcctctgtgtataagaattattcattacacattttgcctgtgactttgtggttctttgcattaaaggtggaacttatttcctcattgtgttggtctgttgctcaatcacatgacttgacttggctaatggggagagagaggtgtgtgtgtgtgcatggacgtgtgtgtgtgtgcgtgtgtatgtgtatgctgggtctacatggagacctcaagaaacactgcatatttctgttcatgcttttatactcagatgatctcacatgagaatgatatgatctagatagtgattgatctgagaagaatgagaaagcacaactaacttgaacccatcttgcaatgtggagtcaagctcagctgattccagtcaagcacagaagaaccaaagcaggcctatagatacacaagggaaaaataaatgcttactgttttaagatgctaagtttcgggaagctttgttacacagcattattgtggcagtcgctgacagatacacttgccacctaagttatctttccaaaactgccatgggattatgttagtcccttgatttgtggcttcttgctgcttacaggtcaagtccaaactctgtgccatgtcattcaaggtccccagcaatccagctctagtttaagcatcagtttctctgcaaatccttccccaactgaattggttcccgtcctctgggtttccagagtccaccagtgatctgctgcaacagtacttgtcaaactggatatcgctagtattatatccatctccctcaaaagactgtgaactccaaagtcaagagtcaactcattcatctttgtagtctcagcatgaacctatggtaaacaaactgaatttacttagcaatgattacagcctgcctgattttgataggaaacactgatagatcatttgactacaaaagacacaaatattgtcccagctactcaggaggctgaggcgagagaatggcctgaactcaggaggctgagcttgcggtgagctgagatcgcgccactgcactccagcctgggtgaccgagcaagagtccatcgcaaaaaagaaaaagaaaaaaaaaaaggactcaaatattatctgaacactttcaaaaaagtaactaggactctgtctccccttcctctaattttctaattcaggagttcagcttcctgaacaacggtctgggtttcagtaggagacagatagtggtgcaaatatccctgaaggtcgtaaagacatgttccgaaagcatggccgtggtccacttaagttctcccttaggatttcagcctgatccttgctctaatgttgacccactgccattgcccaaatagagtgagctgaaagcaggctgaagtttgattttcccagttgatttggtcatagttttgcccgtaataatgttgctgttttccctgggctgtgactgttacagatgagtcagagggagcagggctgtagccctcagatgggtcgatgttatcgatcctcaaggctccatgtcatttccaggggatttgctaaagaagctacttatgttcctttttcattttcaccaactcattaccagctgctgcagccttcgtatgcctcagcaacacctggagaagtggaacatgaccgtccgatttgagttcagacaccttcctttgaaattcaacacaaggcaacatgcaacccaccaaaatctgagtcaaataaggaagtcaggtcacactggcccacaggggtttggtattttttgttttgttttaaaaagggcagcctggccctacactaagcaattgatcccctggcttaacttttaaattaagaccattgtaaatttgggaacttgagaagacatagagaggacacccataatactttgcaaatgtcaagtgcctctcgatgttggttacttttcaaaggtagctaggttacaatgtaccctggtaatgaaaaaaccccgtcaggcccactccacggggtttcagtcaatatacataatattattgggctttgcaaggattaaaggttgtttctctcacagcctcacaatagggctatttatttttttctacccaaggcacaaaagaagcctccctgtttacagaggagcccaggacattttggggctccaaggcggtccagacttctctttgcacacttccccctgctggtggctttgtagttaacctaaaaaaaaaaaattaaactcttttaacctgcagacaccaggattgaaaaaagccaaaactaaacaatatttattagggattgatatggtccataagtcatttctagagtatagaagctctggtgtcttccagttttattctgagagtaaaagctttttgtcactccatcctctccctccaaacctaacgggccttcagtgattccatatttagtgtactgtggaaccgcccatcctgcagaatggagcccagtacatggtatggccttatcgatatttattgacattaggaggctagagacagcacatcagaaaaattgtgtagtgtgtcacaaccatgcctaaataagaaaaaggaaactccttttttcattcaggttcagtttggcctgaatgattaaaagaaattgtagtcttaaaatctcataacagagatgcgatgattagtctgtccaatgaaacttcttggataaggaaacacaggattatgcagaatagtgctgagctggctgcagggacgacccaattaactcttttaagcatcttaagaatgccagagctttcttaaaattagtttgattttttaaaaaatataaatacaggtcaagtgtggtggctcatgcctgtaatcccatcactttgggaggccgaggcaggcagatcacttgaggtcaagagttcgagaccagcctggccaacatggcaaaaccctgtctctactaaaaacacaaaacttggctgggtgtggtggtgtgcacctgtagtcccagctactcaggaggctgaggcagtagaattgcttgaacccgggaggtggaggttgcagtgagctgatattgtgccactgccctccagcctgggtgacagagcgagaccctgtctcaaaaaataaataaataaaaaagtaaacacatacaacatgaaatttatcattataatcattctaagcatataactcagtgtcattaagtacatccacaatgttgtgcaaccatcaccatctaactccagaatgttttcatcaacgaggtggaaaccccatacctatcagcagtcattctcccatttcctcttcccccagcttctggccaccacaaatcaactctctgaatctatggatttgtccattctagatatttcacataaatggaatcctacaatatgtagccctttgtgtctggtcttttacttaacctaatgtcttcaaggttcattcgtattgaagcatgtatcagaacttcatattttaaatagctgaataatattccactgtatggatagatcacattttgtttgtccattcttctgtcaatggacatttaggttcttggatgtggtttttgcttctccttatggcaaccaaaattcacagaaacagcatacagacctatgctgttgtgattgtttctaacacgccatgttattaacagattgtactgtcaatcaccatcaataagtactagcatgacaggcactcaacccatgctgcttgatgagagttcacattcttgcctctagggctgtggttgggcaggccagaaataaagcaagaactacagtaaatattaaggaatggtgcaggcagtatctgaacatgtcatactgtagagatgccctacaactggggcaggataatactgaggcatgcccagttgacagtcaaagccctgttgcatctatgagaccctgctgtctgaggggtactgcaatttcctatcagtattttgacaaatggttctctgataagcaattctgaaataaaggattggcctacaggcagtgagtagagagtactgtgatggcttcttctggactggtcctatcttggaatcaggttggtgagagttgaaggctgcctcccccagtcagtagggtcccaggaaactgggcaagacttcttttgaaaaatatgtttggaggctgggcatggtggctcacgcctgtaatcccagaactttgggaagccaaagtgggcagatgacctgaggtcaggagttggagaccagcctggccaacacggtgaaaccccgtctctaccaaaaatacaaaaattagccaggtgtggtgacacgtgcctgtaatcctggctactcgggagcctgagtcaggagaattgcttgaacctgggaggtggaggttgcagtaagctgaggttgtgccattgtactccagcctgggcaacaagagcgaaactccctctcaaaaataaaaaaattaaaaaaaagaaaaagaaaaagaaaaatacgtttgggcattgggtatacatagacataaagatggcaacaatagacgctggggactactagagaggacaggaagggagtagggggcaagggttgaaaaactaacttttgggtactatgcttactacctgggtgatgggatccattgtatcccaagcctcctcatctcacaatactttcatgcaacaaatatgcacatgaacccctgaatctaaaataaaagttgaaattattaaacaataaaataaaattttgatattaaaaaagaaaatatggggaaagctaggtgaaatgtaaaccaattaaaaaaaaggagtgggtttccattgacaagtcagaaatactatgtcaaaggatgttaaatagatgcagtttacaggccttctcagaggctttaatattccagtgtgcaccctaaaactccaatagaccaggcacagtgtgcattattttctaaaattctttgaccgtagaatcccttcatgctgctatgttcattgcacagtttttgtgctatacaaaggcatctggtgaagggggctagtgggagctgaaatgtatgtaccctgcactttgcttgccaaggtaagggtctgtggggctgtgttcacccagaggggttgcattctttgtgtgtgtgtgtgtgtgtttgtgtgtgtgtctgtgtttaaagtttgtcttccaataacatcctcctttttgtaattttcataaggatgctctataggatagtgaagtccctgaaccctttttggtggagcacgggcgatggatgtttttgtgcatgggagggaggtgtactcagggacaacagtggtccagggaatctctgggcttatcctatatggggaaagctgtagagctggggagaagcactgttatcaagggcaaaggaatccaaagattgatctctaggggcattgcgccatggaattcattagggacaaagactcttgggaagcatagcataaccgtattgttgtaatcaagtcatcatatttgaggttttgaacttgacttgcttctgacctctgtagaagactgagcttgagaatgtgcttttctatatattataccacgtcttattttttctgcttacaaatggtatgtgtgcccatcgtataaaatttgtaaactgcaaaaaaatacaaagaaaagtcactgttaatacctctattcatggttataatttcgatgtatctattttatacatcttcaaatataaagatatattttattgttatagattatttatacttgagtatatattttattttaaaaagttgcaatcttttagtaggttttgaaataaaattgtgatctcctatctatactaatctgtaacctcttaaaaaatcacatatcacattgggtacagtgtacacagctcaggtaatgggtgcaccaaaatctcagaaatcaccgctaaagaacttactcatgtaaccaaaagccacctgttccccaaaaactatcgaaaaaaaaatgtatgggaactcccatcttctctgaattgtatgtaaaattgtgtttgtgtacataaagtactgtttctttttctgaaagtaaggtctgtagtttttctcgccttctcaaagggatcatgtcctaaaaaagatcaaagtctttggtagcagtgatttgtaaactataaagtactattcaaataaaaagaccctctattgtacacattcttaaaaaaataaaaatgaaaaaatcacatatcaatatattgtatatactttccatacctttaagtatcacttcacaacatggctgcacaatgtattattgtacagacataccatattttatttaataaagttaaatatttaattgtattttatttaatacattgttggacatttaggttatttaaaaattttccctattatacataactcaatgatgaactctttttttcacatctctgattgtttctcagagcttcttacatcttttcttcatactcctataatactgctaaccctgatgtagtcacttctagttataattatttcctaaagatgagtaagatactaagtgtgaataatctctcctgatatgagtgttatacattaagatagacaatgcaaaattgtgcatttaaagcacttagctttaaagtattattactttgccttatatcataagattttttcacagatgatatcgtctatgtaggaaatctgaaaaaaatcaacaaaaagccctcctggaactaataagtgattatagcaaggttgcaggatacaagcttaatatacaaaactcaatcactctcctatataccagcaatgaacaagtggaatttgaaattaaaaacagaataatatttaaatgagaattcctcaaaatgaaatacctaggtataaaattaacaaaatatgtacaggatctagatgaggaaaaccacaaaactttgatggaagatcaaagaagatccaaataaatggagagatatttcatgttcatggatacaaagactcaatattgttaagatgtcagttcttcccaacatgatttatagattcagtgtagtctcaatcaaaagcctagcaggtcattttgtgtttattgacaaactgattctaaagtttatatgaagatgccaaagaccaagaatagctaacataatattgaaagagaagaaaagagctgaaggacaggtactagccaacgtcaagacttaccttaaagccacagcaattgagacagtaaagtattgggtaaaaagatagacaaatagatcactggaacagaataaaaagcccagaaatatacctgcataaaaagtcaactgatctttgaaaaagaaggaaaggacatgtgatagaggaaagatagtcttttaaacaaatgttggtggaacaactggacatccaatataaaaaaatgaatctaggcataaacctccttacacccatcacaaaagttaactcaaaatgtgtcacagacctaaatgtaaaacataaaactgtaaaactcctagataacaacataggagaaaatctagatggccttgggtttggcgatgactttttagctataaccccaaaagcatggtccatgaatgaaagaattgataaactagatttcataaaaattaaaattttctgctgtgccaaagacatagtcaagagaattaacagacaagccacagactaggagaaaatatttgcaaacgaaatatctgataaaggactgttatccaaaacatacaaagaactcttaaaactcaacaataggaaacaacagtctaattagaaaacgggctaaagaccttaacagacgcctcaccaaagaagatatatagatggtaaacaagcatataagaagatgctccatgtcatatatcatcaagaaagtgcaaattacacaccaattagaatggccaacatccaaaataacgacaaccccatatgaaatactggtgaggatatggagcaataggaactctcatttactgctgatgggaatgtaaaattgtgtagcctctttggaagacagtttaaccatttcttacaaaattaaacatactcttccacatgatccagaaactattctccttagtatttacccaaatgagttgaaaacttatgtctactcagaaacctgcacacagatgtttataacaggtctattcataattgccgaaacttgagagtaaccaagatgtccttcaccaggtgaatgaataaaccatggtacacccagacaatgggacattattcagtgctaaaaaggaacacactatcaacataaatgtatattactaagtgaaaaaagccagtctgaaaagactacatattgcattattctaactacatgtcattctgtaaaacgcaaaactgtggagacaggaaaaagatcagcggttgctataggctagggaggagggagggatgagtaggcagggcatacatgatttttagggcagtgaaagtactctgtatggtactatagtggtagatacatgtcactataaatttgtccaaacccatagaatatacaacaccaagagtgaaccctgatgtgaactatggactttgggtgatactgatgtgtcaatgtagatttaccagttgtaagaaatgtgtccttctggtcgtggatattaataatggcagagacaacacacgtgtgaagacagagagtaaatgagaactctttgtcctgcttctcaattttgctgtgagcctacactgctcgaaagtgtattacaaaaagtagatttagcatcacaatgtacacataaaatagttggaggtttttcttgttcaaaccagctaccatattatgtggttatatttctttgcttgacatggagttttccaaggacaaatcatgaaaagcagatgggcctcatctgaccaagacaagtcaaggaacacaagctaacatgtctcaaaggctgtttctgagtaagtgcctggcaccatatttctagagattttgcagaaacgtggccaaaagagtctcatttataggaaaaaggactctattatctcctgacagatgaaatgctatagtagccatgtagaattgtttgctaaaaagatgtctattaggtgtctttttcaaacacaggctcatgtatggaaacctgaatgtttcaaccaaatggacaaagataatgagggtgtaacagtaactggcacaaggtcaaaaaggaaagttgcttgacgtgaacacagactaccttccacgatcttctgcttggaaaggctgaatggtggaggtggctgaattgcagaatgctctgatttagagatacctcttaaagcttaagctggttttcctaaacttcaatcacctgcctatcaccttcatgattttgccctatttctgtgtcaccttcactgtgattatttttcttgcaatagactcacactttgatttaaatagatttagcctcatcctaagagataatatctatgaaatcatgagattatgtactggctatatatttttatatatgcatacatgttaaaattaaaaaattattagtgtactgccaagtcttgtctttcacatcaccatgggtatgtattacacacttggagaggtactagtttaaagaatcctttttttgggacaaatacggaaaatatgactgtctacaatagagagtaaacatttgaggcttattattctgaacagccctataggctataaatcaagccaggttttaaaagatttgagggcctggtgtggtggctcacacttgtaatcccagcaccttgtgaggccgaggtgagaggaatgcttgagtccaggagtttgagactagcctgggcaacatagggagatcttgctggtatggtggcacacacccatggtaccagctactcaggaagttaaagtgggagcgtcatttgagcccgggaggttgaggctgcagtgagctgtgatcacacaactgccttccagcttgggtgatggagcaagaccctgtctcaaaataaaaaataaaaaaataaaaaaattgaaaagatttgaataaatgtctagagggcatatccgccacaagctgttcaggtaggggtactgaagacactaacttggtcctttgatgtgatgtcatgacccatgaacactgtgttctgcatagtatcatctgaacacaggctgaatagtggcccatatgaatttttactcccacctaacgttgcattgcttgtctgtgggctccttaagcaacagccacttcactaactcactgaactgacagtcaccgtccattccctttggaagtcctattgaccgacacctactacactccacacagtcccaggtaatatcctacactctcgagcacctgagctcctggtcccagaagctgagatgtatccttcctaggagtccaatgtgtttgcccccaagcctcttcatggaagtaattcttgttcataaaatacacgacttaatgaaataaaatataaactggggacataggggcacaaaaagagttgcttctgtgacagctaaactagctctgtggaaacactcaggtcagtcactataaatagccatgtaggcaggacaactgtaactgaaggattctgccctcagggcctcccaggtgcctcaaaatctcccttcctgtcaaagaaatggaaacaggaaactgtagacaagcaacagggagctggttcctgcaataagacagcgcggaactctaagtggatcactcacagaaacggcttcgtcctacatctaagaatctgtgagtgaatgtacacatgttgttctaagctgacatgtttaaagcgcatgctattttaaaaagtgcgctcctgctttagtcaacatttaaaattaattgagcaagtacgggctcatgagaggtttcctatgagcacgtatgaaagctgttttcactgctgggcctgaaatattaggcatatgtgtctcggccttggcctgtctcatgggatgtgagctccccaaagacagagcgtgtattgtagccacctttgctgattgcacagagaataaggccttgtagttatggatcagtgttcttacacttgaactacagtgtctttgttttcatatatttgaattcttccaaattgatggtacttcccaccttaatcttacatatttttttctcattgccaatgacatcagtctgtttgggataaggaaatggctttgattgcactgttcattcgtccaggattggctagtcagtgtgaagcagaggagggatcttctagcgccttcacgtgactgacgtatggcttggccaatgaagtatttcatactagaatattccacgaataggggctataggatagtgaagtaattcatcacgtgtatttaaagttgaatttaccgatattttatggtattagatattatttctattaacattttatgctgaaattacagaatgattcgtgagtactgaatttttgattgcttttacactttctgggacactattaaacttgatttacgttaatagcactgtaagaagatattaacaatgaatttccaaaagcacttagcatctcataattggagttaaatgacaaaaaaaatgaggagataataaagtaaagagagaaaaggagagagaaagttttgacaatattctttttaacctgtggttcttaataagatttttgcaggattgttttaggttagcaaagaatcaaatccccgatcaggagagatgacgctgatttattaaaggagttttataatacagaataaagaccaagctccaggtagagtgcagaactttctacttataggagagaaaattttctgattttcagagtaggaaggaaacttcaattaccacctttttcttccttccatggtgactagaagataatttaatttttttaagaaaaggaattgatttggtcatagctgctggattacagagaggtaggcttataaggcaaaaacatccaagctagaccgggcgcagtggctgacatctgtaatccgaggactttgggaggtcgaggcaggtggattgattgagctcacgagcccgagaccagcctgggcaacatggtgaaaccacatatctactaaaaatccaaaaattatccaggtgtgatggtgtgagcatgtaatcccagctactcaggaggctgaggcatgataatcatttgaaccagggaggcagagattgcagtgagtcgagattgcaccactgcacttcagcctgagcaacagagcaagattctgtctcaaaaaaaaaaaaaaaaaaaaaaaaagacatcgaagctgaaacaacaataacaacaattattataacaaattttatttagccttcattatgtatagactctatactaagcaactgacacctataactttatttaaccttcacaacctccctatgtattaggcactattattatctccattttaaagataaggagaatgagaaccagagaaagtaaatgactttagcacgtagtgccatcaggacttaaagccaggcagtctggctcctatacaagtacttagccatcatgctttttggagcataacaactaagttattgataatctggttaacattgaagccacattacatatggcttttgcaggccttatgtgcttttacctacaagggccccttcctttctaaaaattattaaacttgtattttatgactgtagtggtataaagataaatattaaaattaaaaatattatgtgttaaaacattttctttgacctaaaagtttactcttaaaatgagtttaaaagaaaccaaggccaggcatggtggctcacgcgtataatcccagcactttgggaggcccaggtgggcagatcattctaggtcagaagttccagaccagcctaggcaacatggtgaaacctcatctctacgaaaaatacaaaaattaaccaggtgtagtgacatgtgcctgtattcccagctacttgggaggctgaggtgggaggattgcttgagcctgggaggtcaaggctgcagttggttgtgactgcaccattgtactccagcatgggtgacagagggagaccctgtctcaaaaaacaagaccaaatgaaaaccactttcaagggcccttaaaaatgttgtgggcctgaagcactgagttactgtagatcatggagaagtcagccttggttagcatcacagataaagccaagaccagaacctgggattacgtggtctcatttctcatgacaatggaatctagaaaactatggtgacagagtaagcgtaataaacaggagataaggaaacagctggtttccttctcccttgtgtttttggaagacgtcgtggcttgggtccctgcctgctattttaggactacaactccagaactgatgtggtctccatggactttacctcaatatactcggtatatactcaatatactcaatatgttcaggattcttgactgataatcctgcctgtaagtaatagaatattagagatggtcagtattgtcagagataacaagatctgctgctcacctaggattctgacttgtgctactgcttgggaagtgattctctggaaacacaaagaaagcccaaccaagctccccagccctctctgctcacagcaacaaactggggattctgtcttaaacagaaatatgatttatccattagaatctttccccaacccagtgacactttgcttgacccattgttcttggagctaaaggacttgaggtcactctgagaaggtgttgaatcataagatttggtccagacttgaatatattttgaataaaagtaatgagggagaaaataactatctatttttagtttccaaatttttcctcaactcccatctggatataggagaaagtcaaacattacaatgtataactacattatagttttagggttaatatgttttatgataaaagtaatctcaattaaggtctgcttgaactgggtccctttcatgaaagtctctcagtggtagatagacagaatgagatttacatgcagacgttatctgaaattcccctcttttaagggcagcatggttcaaaagggactagtaactcatgcttttattcagtaaggaaaatatcgcagaaataaaggataaaatagtttccttgtaatttttaattcatctaaaatcatgtgattctagtgactttagttcataagactcttgaaagaggacagagaaccaaataatatagtctttatagacttcatttggaaattaggtattatttaccttaaaaatgattgagaatgtgaatctaggattctgctaagattacagctaacaaaaggcacaaagtaaagtaaaaagggattggtaactgataagcaaatgatagatgattgagtggatagatacatgaatggattaatgaatagatagaaaagcagatagatggataatacagatgaatgaattaatagagacacaaatggatagacaaggagatgacagataatagaaagatattcatagatcaatacatggttagtaaatgagtagcgggatgcacatggatgaatagatgacttggaagcagaataaatagttgatatataaatgaatattggtagatgaatgaatagatgctagagattgatgaatgcaagggtgaatttggaatgaaattgcagatagatgcaagggtatgacaatattatgattgtacccaactggaatggaataccaatgaagataatgacatttcttttcatggaactattttaaatagtttaactgttttaggaacgtatggactggtggcagaaaattagtcagtctcgaagagccctgaagtttcataataagtgtctcaatgatataaaaaaaatacatgagtgtgccatgattaggccacttctgaatcctccctagtgccccattctggcccatttggcctctttagaacaccatgcaaatggaggagaaaagtgacttcactgggcagcctttatgcatccttggtgatacacaaaagtcatccctttttgcctcttcttaactctgatattcacatgtaccttcatcagtagacctactcgggaaggcctggtgctataattaatccatgtcacaggcagatgtaagattggcagaatttatgagtgggtttgagctactgtgatgagtaggggcacctcagcccgtgtgatataaattcctctgctaattggattgctagagctaatcagaagccagaaaaggaataaaaaaatcagtgttcctgctgccgctgctgctgctggctgataaagcagacagctcttttcaggacaggagggcggggggagctggaattgaatcctcatgcggaggtctcactctagatagctatctcaaaggcgacacagcccttctgtcgccaggccaggaggagacagatagggcaatgggagaaagggtgatgtgagcccagagagattgtattaccaaattgcaaaaacggagtgaatggggagagatgaaaggagccgagaccaagactgggagcggggaccaccatccaatggcctgagagagctggaaggcttttctgaaatgaggtaccactccccgggacacaggtgcatgcccagcatcactgtgggatatgacttcaggaatctgaggcctcatccccaaagccaagaggcgcttgcaggagaaagccatctatatcttgtcgtttagcttcacacactcttgcgttcactttcctgaagacgagagaaccgaggggacaatgcaaatcccattcaatactagggcaagtgcaattcagggagcttagctgaactgctcaagatgtagggcaagtgagggaaaaagaccacgtttaaaacctctcacctgctggaaaaccatcagcgcatagcagctgagagggaacgctctatctgtgctcactctttctacattttggaagcagcgagggggtgataaggcaagttcgtgttcattgtcctgcataccttttcctccagggatcaatagttcgttccagctgagagcgtgaaatgtgtctaacagggacacaggttagatcctggtggtccttatctctactttgcttgtctaagtctacgccacttctccaagaagcaaatgtatccctaatattgggtttcaccacgccgagtgcccttcagttctcgttaaattccattctttgtctcctgtattcttttctctctgtgattaccacttctttgcatatttcttctggagctctctacataggctccaaagccctgccttggaggtaaatccttagcctcgatgagtaggcagcaagcccctcttgcacacaacaaagacttctatttttttttctatcttttgggcgacacgataaaaaataaccctgtatttatgcaaattgcaaagtagcgtgtgataatgaaaacaaaacagtgctggcccgcagccaagacatggcgctgacgggagctccccgaccatttggctcttgattcttcggggaaagcagctgtagagaaatgagaatacaggaccccctcctcacactcgcacaccctggttcgcacgcattccggtacccgtcacctcggagccagcgagacctgggatccaaatgcggttctgcctcctccggccgtggagcactgcagtgtcgtcctccacgagcctccctgcccctgctcctgattccctttcaggaatttacaaacattttccccagatcaatatccgtattgattattcattgtgagtgagtcgtgtgtctttggtgatccagcttgcagaggtagcaggcaaaggctgctgcgggggaaaaaaataacagaaggcgagagggacccagctcttgctgggtctgcggctgtcggcaacacagaagggaagagaaaaagagaaaagcacctcaaaaccaaggaatggacacgggtggaagagaaagagggagcaatagcaagaaaaaaggaatcgatgactggacatctggtcccagggaatctcgatggcttggaggaaacccccatcttgggtctgctgttacgtgcaggacgcaatggactttgctctgggagtgcaaagtgactcacagttttggtatctcctacgtaagagctttggggggattccttggcttgctgacaggcaaggaagacagcggcagcagtgaggtaaaacacgattacttccaactgccttgcggaggaggcgcagtcgtgcggtgtgacttggacagcttgctgctctctgatggcacgcggagggagaataattaaaaaggccagcatcacttactaagtgagtaaacacagagccgttccaatcgtgctctccagctaatgagaagctgtaatttcttatacttcaaggcaagatgagacagtgatgggttcagtggagggtgtgtttgcgtggatatgggggtggggggtagtggtggtggtagagttagatcgactaattgttggcaatgtttaagaaagggattactggaaaagacagtgaaatgatgacaggaaaacatcttggaccagagccaaaaaaaaaaaaaaaaaaaatcgaggcaaatcaagtctgcagctcggagaaaacacccgtcgctccggtgggaagctccgacgggaattgctcgatgttccttagccaaggacggaatatcgtgtgagcacaaggggacagaattagggaccaccagagtccagaggaaagagctacggtatgccagggtatacagtgatgtcatacattgagaaaaaaaatgaaaaccccaaaaccagaacagatcaaaccaaaacaataaaaaccaacctgtgtcctttcctttttatgggaggcttctgcttcagtttattaaaagcaaccctcaaatgtaccttctgatagcaggagctgctgattctctgtttgtctgcagaagctgctgcagggttactgaaagacgctggaaaaaggaggttgaggaaattaagttttccattggttgggtttctggcaaacgtgccaggcgatcgtctgccatttggacagccatgggggtgccagtttgggattcctcttctgttgtcacccagctttggcttggtgattttaatacagtgttccaaacacacatgacaaagtggggacctcaagtaataaaacgagctggattttctttctttctgggtgttcagttaactgagctaaatggttctctttcacatgagtggaattggggctctttaaggatttctgggactggaaggtcacccttttaagatatcctccttcttttctgattgaggttttaatttcacattgcttccttatttaggactccccagtacattccaagtttcctgagcaggagaaatagattttgcagaagtgagccacggagacccaaatgaggaggaaataaaccagctgtggatgacttgggcaccctccatcgcatgtgtttggcattcatagagacctgtgtctgcagtgtgtgtgtgtgcgtgtgtgaaggtatcgtggcaaatgtgtgcttgtatgagtgtggctccgtgtctatgtgtctctccgagagggagggaaagggagcgaagtcagaacaggcggaatgtttgggtatttatgtaattcatgcagagaatgttcaatgctgcaaggcagacagtcacccatccctggactctgtggctgtggagggcctatacagacctgatctgaatgttaaatgcaggagatgaaattagcatactaaccaaggatgtcaacccctcctcacaatcagtaaatggctgtctcctctctctaaagccggcacagccatgcgcgccagccacttaactatgtcccctgtcagatccttttttgtgtttgtttttttgtttttattttttgatgaaagactggaaattcattaatgaggagggaaggaagagcttcaaggggctgtaatgaaaacaaatgatcctctttaaacctcatgatggccaaagccaggcgggcggggattgctttctgctctggggttggagaataggaaattccacagacagcagaccacttgaggagatccaaagaatgatttgcttgggaatatttcttctgtgtggcacagatcggccatgaccggtgtgtctgtgttaataatatcgagaatgaactttatcttcctaactgtaaaagagaagtgttgtctaccagatgtttctccactgggctcaaggttatcaaagtttcttgaccttgttggggtaggaagtgtcttctggacttttttggccaattgcctcagcctttgaagtgatagaaatttttcttttgggctgtgcattaggccttccccaaagatagtacttgcttttattttaatctctatcatacaaagaagtacacagagaaaaagatttgatgtccacttttagagaatcccatcctaaagcagacaatgctgtctagaagctgagaatcaggcatattagccccagtatttaagctgggaaatgtttacttactttttctttctttatttatttactttttttgagacggagtctcactctatcaaccaggctggagtgcagtggtgcaatctcggctcactgcaacctctgtctcctaggttcaagcaattctcctgcctcagcctcctgagtagctgggattacaggtgcccaccaccacgcctggcaaatcttttgtatttttagtagaggcagggtttccctgtgttcaccaggatggtctcgatctcctgacctcatcatcctcctgcctcagcctcccaaagtgctgggactacaggcactttgcctacatggtgaggcaccatgcccggccactttttctttattttaaccactctatcctcagaaacaaacttctttcttcccactgtacttcactgatttggctttaaaccaggggtcataactcggaaatctccagggacctgtgcacaccagcctgaagagatgatgaggaggagtggggcttgggatgaaatggaccggagaggcactcggctctggtcacctgatgtatgggggaataaaagttgtgccatgtgttgcctgatcttccactgttccaagaggtggtagagattggtatgtgtaaatatcaaatatatcaattgtttttttttttagatagcatctcgctctgtcgcccatgctggagtgcagtggtgcaatcatggctcactgcagccttgacctcctgggctcaagcaatcctcccatcagcctccagagcggctgggactataggcatgcgccaccacgctaggcaaagtttcgtattttttgaagccaccaggtttcaccatgttgcccaggctagtcttgaactcctgggctcaagcaatctgcccacctaggcttcccaaagggctgggattataggcgtgagccattgcacctggcccaaatatatcaatcttttaaaaaccatctatgagttaagtgaaacatatttgcaaagacagttttagcctacagacactactctgtagtctttgtgttagtctaaagttcctagaacaggtgttttggcttttattctattttgtattatttaaaaatatagatattagcaaggacacggcatacgtcaagggagtatgtgttttgctggactaagagggaaatgctaatttaaaacaataaagagaggaagggaatggatgtcagtgtggcctgcatgccctgtggtcaacatcattttagcaggcatgatgtaatgccatctttctttaaggtagtgatctctggctgggcgcagtggctcacgcctgtaatcccagccctttgcaaggccgaggcaggtggatcgcttgagatcaggagttggagaccagcctggccaacacagagaaaccccatctctacaaagaattagccaggcctggtggcacatgtctgtaatcccagctacttgcggggctgaagcacgggaattgctgaattgcttgagcctgagaggcagaggttgtagtgagctgagatcatgccactgcaccccagcctgggcaacagagcaagactccaccttaaaaaaaaaataagtagtgatctctacaaagggtttttcctccacaaagggtcataactgggaagcttaaatatctaaaaagaaatgcattcacatagttttgatgcagatctacatccattttaaaaacaattagtgattagtgtcagttcaacatttttctttttcattttaaaaaatgttcttcttacccatccacagcactcttcatctcaagtgagtaagaaaaaaaagatagaaatccccagaagagagagatcctgcctgtagtttggaagaagccacgcggtacctgagataacttcaacagcaaagggcacttcagcaaatggtgaagacagcaagaaggctcctcttctcacacaatgacatctcacaatcgtgcagggctttccaatttccacggtgctcttcacacatattaccctgtttaattctcactacaaccagtgatatcggcgagacagatagtctttagctaactttacagatgagggtactcaggctcacagagagaggacttgcctaaggttgaaagataataagagacagctgcaggtcttctgggtcttaatctggtgccattttagtatttttcataggttcttataaaaaacatcctctttagaacccgtgacttaaaggtgccttgattcttaaaaaataaaattctttagagatagggtcttgctgtgttgtccacgctggagtggtcacagctcactgcagccttattctcctgggatcaagtaatcctctcacctcagcctcttaagtagctgggactacaggtgcacaccactatgcccagctaattttttttaaaagatggggttttgccatgttgtctaccctggactgagactcctgccctcaagcaaatcctcctccaaattgctggaattatgggtgtgagccaccaaatgcagcctttttttttttttttttttttttggagagaacacggtcttgctttgtagcttgagctagtattgaactcctggcctcaagctatcttcctgcctcagcctcctaaagtgctgggattacaggcatgagccactatgcccacccgcttccttgattcttgatccatgctcatccccgcctcacttcttcaccatgaggttttttttctcatagcctatgttatttgtagttatgtgcactttgaaaatacttcctgtatcctgccagcgaggaagaaccacagctaatttccactggcaaaggcagaagccatccttaacttcccattttcctctatttgttcctcctttccttgaaagtcaagtttacccatgagctggtctacatttgtactatttttacttcttcactccgctttgcatctctacccagggctatctgctttcattcctactttcccattaaaactgctctaagtcattaacaaccaattccactgtgccttcctctctgaatcattgtattcagtgaccactccctctcgcaagacgtctcctctgtcatacctggcatcattctattccttcttcatttctggttacctcctctctagcttcatgtcagacttatcttcctttattaatgccttaaatattagtgtttctgaagagggtttctgtggccaccttctattcttaactgtaaacactttgttttgtgtaatgtaaagccttggcttcaatgatcatctataggctgatcatcaattatcatctccatcccaaaccactctcctgaattcaacccaggatctctggctccctgctgttacctccttgggatggtccacgagcccttcaattcagggcaccccaaatcatccccaaacctgcctcccttcaccctcttctttttctcccccagctgctcttcaaattctctcatttctttccctatttctattttctcttttttattgtattcctatcgctcttctcttattttcctagtggcttttccaaaggcctaactgttctcatcattctcagatatgccttgcccacaatgccttctctgtactatgtctaattgacctacagaaagtgcaaatgtgattatcttgctcgcctttgtgagatccttctgaggatcccaccttcttacatggccttccaggctgttcatgacctgtgtgctgcctctccctcgcctgctctcttctaactcgtccattgcccatgctctgcttctaggtcataaaatgccccataactctttcatgcctctaggattccatatgaggttcctgcttcctggaacgttcacctcggcttccttcatttgaccaactcctcctcccctttcaagactgttccagcaagaagcatttctcccccgaccgaaacctcccatgctgggttacgtgctactgcaagaccctattcctgcttccctctcccacagcatgactccactttcacaatgaccaagttttcccatttgaccatgagacacatggaggcagagaccgtgcccttcatccctgtcttcccagcacccagcacagatcccaaaataaactgggtgcttaataaattaatattactatttttattccaagtatcataaatagtatttttccagctgtaagattacaggcctccaaaataatcaagctgagggaaatacagcgaccgtttcccatagagaaaaaaggatttcctattgggcaattctcacctacatcacttttttgacttctttcaggcgagagacaagcagtggggtggtctttaggtgtttgctgatgtggtagaaactttggagttaattagaagctctggctaaggccgaacttcctttgcagagttcctgggaggaaacactaaattaacagttcaaggttactattagaaaaatggcctgtttccctatgttatgcctcagagagtttgttcttctctctgccatttctaagatgtttccattttcctttttacctgggtaggtttgccaccctaagcccagtcattccaacacaggtgaaagctcttgaggtcagggactgattcttcgcctatcttccagcagcggtagattctggggcactcaattagtacctggtggagttgaatagtgagaaaatctgctcatcacagaagaaggaacggggatgatttcctaagttcccattttccacaaagcagaaaatggcatgagatcagtagtaccagacctccctggcagtgctagaaatatctcaagatactatgagcaatttctaaatttggaaatgcactgattcttgttatttgcagtagttatgctctgtaaagttgccacagacactgagttagtgaataccgaaccatcgctcctaggggaaatagagaattaggttcctgcaagcctctggtcacaatgttttcatcaatgaatcaatacagagcctcgttttatgtgtgttcctgttgaagatttaagaaccttattttgtgtgtgtgtgtgtgtgtgtgtgtgtgtgtatatctatacatatagttacttaacattgaactcatggccaataacactataatgcatacctgaatgaagcttaatttacacatgtgttttctttgtaagggacaccacagccttcttgtgcttaggaccaccagacggtacttttgcatcatgcttgcagggtattttcttttctttttttttttgagacagtcttgctctgtcacccaggctggagtgcatgggtgccattttggctcactgcaacctccacctcctgggttcaagtgattctccagcctcagcctcccgagtagctgggattacaggcacatgccaccatgcctggatcatttttgtatttttagtagagacagggtttccccatgttcgccagtctgatctcgaactcctgacctcaagtgatctgcccacctcggcctctcaaagtcctgggattacaggtgtgagccactgtgcccagcgttgcagggtattttaaatgacaaaatcaccaactaagagcacaaaatgtcaacaacatggcattatgaaaagaacacttgtttatagtatgagagataaaacaggaagcagacccttatttgacctcagctgggaacacacacattgggcgacttgatgttttcacctccctgcatgtgtctgtgaataatgatgaaagtgctgcaagtattgattttgaagttacaactaaatttcaatgagtaggtgaatttgcaaatacggaatctgtgaataatgaggtaatacatactatcaggatatactagtgaaagagtagagttttgcttatttccaaatagagaaaaggatcatcaaactcacagggcatttctgactttgaagtcccttctttaaattgtacaaaacatctactttctggcaaagttcatctgtgctttcttagaagttttcatataaataattggcactcaccagaagttgtctaactgttggggatggggtggtgcatttttctcaaagaaagaaaactggtttgctgccaggagaggcaaagactaggcaattgatgagaccccactggaagctgaaggacctcccgctgtttatgatttaaagtcggccttggcgaaatgacagatgactcacgttaggcacctgtgcccatatacagaggattatacatgatagtctgaaaagtattcttttgagctaaatcttgccctttttgagttataccatcatgacatttcatatggaaagcagctgcttagaaactcatttttgctttttgcttattgagtcccatcttgttgcaaagaatggatacagaattctaaaacgcaatgctacccttttcacactaaccaaaggcacagaggtacatgtgttttagatgtcaggaaagggggtcactcaggcatgcagagtggactgagaggagaagtgtagtgagattcagaaactaagagtaataaaaggagggttgggggccgggcgcggtggctcatgcctgtaatcccagcacttttggatgcccaggcgggtggatcacctgaggtcaggagttcaagaccagcctgaccaacatggagaaaccccgtctctactaaaaacacaaaataagctggacatggtggcacatgcctataatcccagctacttgggaggctgaggcaggagaatcgcttgaacccaggaggcggaggttgcggtgaagcaagatcgtgccattgcactctagctggggcaataagagcaaaactccgtctcaaaaaaaaaaaaaaaaaaaaaaaaaggagtgttgggcacttcttactacgtcttattaaaagtctatttggagttagttccatcaggatcagaatctctgctctcttattagtattgtgatcctaaaacgttgagtgacccctttgagaactgctctctcttctgtgaaatgggaccctaataccaacctcttggaatcactgtgaggcttaaatgagataacaatgtcaagtgctgggctctaagtccagcagaaagttggtaatcattgcttttgctagcatcttctgggttcctaactagcaatctgactttttgggcatattcatggagatacggaagactggagttgaagagacctgctctgggtcaacttccttactttatagaggagaaagtaggctgagtggggtccaaccagcacaagtatcacaaaggtagtcagggcagaataagaaggagaacctagctccctgaagcccagttcacaattatacagtagggtcctggtgcctagatttccactccagatcctccttctacaactatgaactgtctgccacccccacacccaccccattagcctggtaactactgctccatgggttagtgtcttctttggcagaaagacttggtgctacatcagccaagttagaattttttagagcaggaaccactgagtgtgagtttttcgtgtctcttgactatacataaaaatagctatgaacagataatactcacagcatattaatgtaagacaaagcaaaacggatcacagaagctacagaaggaatgctccttttaaaagagatcaattatttcttcagttctctgtagcaatttgcaagatgctcccttggaaaagcccacagggaaatgctgctggatatataaaccctaaagcttataactgatcatgcaataacgagacaagaaagctgtgctggacaaactggatgaggctggttaatttccaacaagcctgtcttaacgagcggagtacaggcttaacactggccatttcaaggtgccagcaaccttgccatcagtgtggaggtgtggggtagagggtaagatagcacagtcctggggaagccattgcagcaactgggccgtgctatggaataatgaatcacgaggcatttgggcaagaagttataaccagaaggacgtggcaatagcaagacaaatcacaatggacttagtgggtcctgacagtgaaaaggaggtcagaggctggagtgtgtggttaaatgagtagggtctaccactgtgcagttcagccaggagagctgagtggtccagacagctacagaagcaccaagattggagctagtggcacagctcaggctggctcacctctgctcagctaagttgggttatataagcaggtatcaacattttgaagtggttatataggcctggtgggatgggtgtcccttcgtccacttcatcacataagagataaatctttgctataaattgctcatgcttcagcaaagaacaatatttcttagtgggtattggaaggtctggaggcaacaggcaaattctatttctccatggctgtgtcccactcactctctattcttcacccatttttgtcctcattgtactcatagccaatcaaactgaggatccacaaaggctgatatcagatgtaacttcatcagaatatcctccttgtgaaagatctgtacctatatttaatctgccaaggtaataggtttaagtgaaacacagctgacatatccaacccactaagctattatatttgcattttatattgaacatccctgtaatattctcgttgctagatggaactgacatttccatatgacggtaaaggctaaattgtgaattgctttcatcggggttttgcttcagtgatttcaccacgctatagacatagacaaaaaatcacaacaaatacacataagtatccaacacgttttgtgtgtgtgtgtgtgtgtgtgtatagtctgttcagtggcttaatttggacttacgcaacagatcacccacccagaatctaattattcagcaaccatgttacttatttggaattgataataataataaatgttttctaagaagctggagaagctgtcactgaagtgacatcatggaggttcagagatggtagagaatgccggtagagaacgcctcaagtgcttggtctcagttggatgtgaggtctgttttaagaatggtacactgatggccaggagcccttggggatcatgcaccatgctaggcagccctcctttcaaagaaaggcttgtgaaatcaggacttgggatcttagatcttttttagtgtgggatttgcaggaaagcaagtttggcctttgcaaggatgggaagtggcagcactggtccatcggaggagggtttttgggaatatttttgagtggcagatgaaggattctagaagagtattcatcctgaggagagggtcagacacacaggcttgacttaagaaggatgacacagtaatcaaaggggtgggcggatttggggtacaggacgccttccactgtgaagaagacagattatccttctctcctccatcctccaagccacatcccagcacacaggctgaatcccagtgacaagtgaaagattcgagaatgattttcacacaaagcctcttcgagggacaggacatgggggccagaagggctttgggaacaaggcaactgattatggcataacagtcaaggaaagagattctttcccagctatggaggagtttccaggctgtggaaatgccaaaggtgaaaatgacaaagtggaattgagggaatttcaacccgaagcagacacctgtgctcatggccataccagccccatgtccagcgggatcccttagtgactggaacctgtgatatcaccaactatggcagcagggagatgttggcacacagtgatgccaccagcttgaggaaggacaggagagactgcctttgcacggacagcaaccaggagatctcccagcagcagggacagagcaggatggggcaccctcacaaagactgatacatggcagaggacttagaaaccagcaggggttgagaagactgatgtgaacacatgtgacatcccctttcccagttcactccccagagtacctgggggagatttggagcagaagtgggggcttacaattgcaggtggaggtcaaagccacctatattaacagagcccagctctatatagctttgaccagagaaactggtgatctcagcaacctattcttggaaactctgtgaagggaggatgggtggtcaaactccacttgtatggacaatgataactaatttagaaccttgcgcttacatttcccccaaaactcatagcagtcaccacactgccctctcattgttgatttactcatctgtctcctcttgcaagatgtaagctccttgaggaaaggaactatattttattcatcttcacatccccacttttctgtttttttgtttgtttctttgtttaatacagtctcgctctgtcacccaggctggagttcagttgtgtgatcatagctcactgtagcctcaaactcttgggctctagcaatcctcctgccttggcctcccaaagcactgggattacaggcatgaaccactgcatggggcccacattccaaattttcaacactgtgtcaggcaaacagcagacactcaatccaggcatgttggatgaataaatagatgatgccttaaaaaaatagatgatgaataagtcataataatgagatggcctcaaatgagaggtaggttatgtaaataagcaaagatggtgtccaaggatgttgttccaaagacgtagggctccttctggggaggctgtcatggggagttaggaggaatttgtatggtccagagctggcccctacctgggcccttccagaaccccatggaaactcatcagattgtagcccctagtactgatctaggtgttcttgaggtgagcagagagggtagctgggccacacctcaactactttaaactcttagtaattgaagaagtgaaagcgtaagagtaagggtcctagaaggtgagaagagatgacagatgaacttgtcctgcctctttaggtctgggaaccttaagagggttgagtccttgggcgtggaccatgataggctatacttcagtgagatgtgggccttgggctgctgtgggatgtgcacagagattattccacaggacagaggccattcccctgtttccttctcttaggatgtagtaaggaagctccactcctgtgagcagtcccagggtcccagccaaggtttcttggttatgcttccaacaagggtggcactttggccagaggagcttcactagatgacagggcagttacatgtctgttgattccaagccgcagagttgtgaccttttaggagagagccgaggcattatgagccaggagtgaaccatcctgaacaccaagcatggctggcagcatcaggtgagtgctggagactagctcttccctcctggccaggagcttgggagaatgaggcttggccaatgaaacgcacataagtcacatatctatgaggtctctgtccccatccaggtttggagctatgaacacaagactcaggatcagaagtctgtgggtaatggttcagaatccaggctgactgcgctcctaaacagccagctgggtcatcgccagccatcgaaccccgaggtgctgggtgggccaggcttttggaagctgtctcctccatgaccatagcctcataatgaagggggtctttcccagctgaacatatctcttgattaatctctatttgctgttcatctatatgtatttaaaaaaggagagagccatgataacacaatgtccttctaaatgctcgtatcttaaagcaagtctacatattctttagatacgatgtgcttaaaataagcagcaatttagggtacactttttcacttttaaaacttgcaactgacttcggttcctatataataaagttttatacaaactagtaattctaaaatgattctttcattcttgactggttgagaaactgagggttgtagaagttttgtaaagtaatatttagtgtccccagaggaagttatgtccctttatactccttcatgtatgtgtgtatttgcttcaaggttttcaggcactgagtgccagtgtggatgtatatgtatatatgtgtatgtgacacgtctgtgtgcctatatgcgtgtgtgtatataatgtgcatatgtgtctgtgtgtctatatacctgtatgtggagtgtatgtgtatgtgtgtgtactgcatatataatgtgtctgtctatgtgcctgtatgtggagtgtgtgtgtactgtgtatataatgtgtctgtgtgtctatgtacctgtatgtggaatacatgtgtgtgggtatactgtgtataaaatgtgtctgtgtgtctatgtacctgtatgtggagtacatgtgtgtgtgtatactgtgtataaaatgtgtctgtgtgtctatgtgcctgtttgtggagtgtttgtgtaggtgtgtgtatactgtgtatataacgtatttgtgtgtctatgtgcctgtatgtggagtatacgcgtgtgtgtatactatgtatataatgtgtctgtatgtctatgtgcctgtatgcggagtgtatgagtgtgtatatactgcgtatatgatgtgtctgtgtatatgtatttgtatgtggagtgtgtgtgtttgtatactacgtatataatgtgtctgtgtctatgtgcctgtatgcggagtgtatgagtgtgtatatactgtgtatatgatgtgtctgtgtatatgtacctgtatgtggagtgtgtgtgttcatatactatgtatataatgtgtctgtgtgtctatgtgcctgtatgcggagtatacgtgtgtgtgtatactatgtatataatgtgtctgtgtgtctatgtgcctgtatgcggagtgtatgagtgtgtatatactgcatatatgatgtgtctgtgtatatgtgtttgtatgtggagtgtgtgtgtttgtatactatgtatataatgtgtctgtgtctatgtgcctgtatgcggagtgtataagtgtgtgtatactgtgtatatgatgtgtctgtgtatatgtgcttgtatgtggagtgtgtgtgttcgtatactatgtatataatgtgtctgtgtgtctatgtgcctgtatgtgcagtgtatgagtgtgtgtatactatgtatataatgtgtgtgtgtatatgtacctgtatgtggagtgtataagtgtgtgtatactgtatatataatgtgtgtgtgtatatgtgcctgtatgtggagtgtgtgtgtatactgtgtataaaatgtgtgtgtttgtctatgtgcctgtatgtggagtgtgtgtgcgtactgtgtatataatgtgtctgtgtgtatatatgtgtgtgtgtatactgtgcaatatgtgtgtgtgtttatgtgcgtgtatgtggaatgtttgcatatgtgtgtgtatactgtacatatgatatgtgtgtgtgtataagggcctgtatgtggagagtgtgtatgtgtgtgtggttgtatactgtgtataaaatgtgcctgtgtgtatatgttcatgtgtgtgtgtgcactgtgcatataatgtgtctttgtgtctatgtgcctgtatgtggagtatatgtgtatgtatgggtataatatgtatatgtgtctatgtgtctatgtgtgtgtgtagataccgtgtatatgtgtctgtgtgtacatgtgtgtgtgtactgtgtataaaatgtgtctgtgtgtatatgtgcatgtgtgtatgtcctgtgtatgtgtctgtgtgtctacgtgcctgtatgtggagaatgtatgtgtgtgtgtgtgtgtgtgcacgtgcacgtgtgtgttgtggctcaatggaggctatactggatgtctcccctatgtgctgagtatgcactagaatggaacgtctgcttttctagaccacatgagtaacgtcaaagaagttgcattcgatccttatattgaagtttttttttaattgaaaaacatgtttttattccaaaagactgagcaggatggtattttaaaaataattcaagtaatttaaatttaagaccctaaaaaaactgtccagtctgtggtccaaatctattctctggcccagcgcccaaggcattttcattagattgggaattagatacgttttcattcacttcaaacttttgtgctcagtgttttgttcttcagagacaagctcacaagtgtcagtggtcacactgacctcaataatacgcctcctttccttgaataatctatttcagttgcattattgccacttaaagatggccttgtacttgcagacacattttcagtggatgtatggggaatgctgataattcccctacatgtttttgcctctaaagttagtaacttgtttgaagaaaatgtccctaacttactttctttgaagccatttgcaaaaagaggctatcaaaataattctctaattttttcttgctattattaaaggagattgtattagtctgttctcatgctgctaataaagacatacccaagaatgggtaatttataagaaaaagaggtttaacagactcacagttccaaatggctggggaggccttacaatcacggcagaaggtaaaaggcatgtcttacatggcagcaggcaagagagaatgagagccaagtgaaaggggaaaccccttataaagttatcagatctcatgactaccacgagaagagtatgggggaaaccgcccccaagattcagttatctcccaccaggtccctcctacaacacatgggaattacgggagctacaattcaagaagagatttgggtggggatacagccaaaccatatcagagattttgtcacactatactaagatttccttaggttttaaaatttcattagtgaaaattctactgttgtatcttcagcaaatagtactgacatataagtaagaaaaaaaacccagttaactcaaagaaaaatgggcaaatgaattgaacaggcacttcacacacacacacacacacacacacaaaattcaaaagaccaatcagtgcaattaaggaaatgcaaattaaaatcataacgagggaccattcccgcaactaccaccttggccaacattgaagtctcacaataacaagtgtcagcatggatgtaaaggatgacagcaacttcctacactgttggtgctagttggctcatacttcagtgttgtctatgtaatgcagaaggtacttttcaaatgattctgaaaccaggtccttatttttcttttctttcaatgaaggcaggtgtactttccccacaagtctgtgatatggttgcactgatagcttcttaccctttcaggtacaataacatgttttcatcaaagtaatgtatcccctgagtactaatacataaaatagccacatatcatgatataccaagcatggtgcttgtacacagtagatgctcaatgaacactaagttgacataagcatatctgtcatgtaataaaacattcctgaaacaagatgttatcaattgctatatattctagccgttcagtttttgtggatgtgtgtgtgtttattttttgttgtggtaacatttatataacataaaatttgctattttatccatttttaattttacaattcagtggcattaattacaatcacaatgaataaccatctagttgtccagtgtcaacattcattttattttatttattcatttatttattttttgagacggaatctcgctctgtcacccaggctggggtgcaggggtgcgatcttggctcactgcaagctccagctcctggattcacgccattcttctgcctcagcctctcaagtagttgggactacaggtgcccgccaccacgtctggctaatttttttgtatttttagtagagacggggtttcaccgcgttagccaggatggtctccatctcctgacctcatgatccgcccgcctcaggctcccaaagtgctgggattacaagtgtgagcctttaagccaccgtgcccagctaccctcattttaatatgtgaattgttagagtcaacttttatatttcaaatttcttcttttttcccttccttcaatacagcccttcctccctcctacatttcatcttttactatctttgccagctcctggtctcatctgcaatctgagtcatgtgtaccattatttgtttgggtgaccagcgatctctgtgtcagaagaatttattttcttcttcaatttggcttgcagttgtccagtagcagaagctgctacattaaactacgggcagttaaaactcaaaaaagtgtctattcttaccaggaataatgtagactcttggtttcagaatcctctgagacctctcacagataatccaaagtaccaaaaatgactagcccaaagtcttagtgagggtactatgggtactaactcaccaactgtgtacagtccccaagttagtctctcttgctaaacagtgaatcactaagctgtggataatgttacaccacaagtgtgataaaacgataacgatgatgataatgacaacagcgagcacggagcactgttaggggccaagcgtggctctaaatctgttacgtgtattaccttatttggtcatcatgataatcccatggcatatgcacaattactagcctattttatagatggggaaactgaggctcagagaagtgaatcattataatcccagaaccttggtcttagtcgctacaccgtgaccccagatgagtagaacccagaagaatgctcttctttctcattctttctggaaggctggatattccaaatgaaaaacagatagattaggttagggacaagagtaaaacacacattcacacacatacacaccacacacacacatgcacacacacatacacaccacacacgcacacaccatgcacacacacatacacaccacacacacacacaccatgcacacaaacgcacacaccatgcacacacgcacacaccatgcacacacaccacacacacaccatgcacacgcacatacacaccgcacacacgcacacaccatgcacacacaccacacacacaccatgcacacacacacaccacacacacaccatgaacacacacatacacaccacacacacgcacacaccatgcacacacacataacacatcacacacacacacaaacacacacacctctttatgtctttgggggtcagtgaggggtggggagggagcttggggaattagccagtcagtaataactgctcaaacaaaaacatccagaaaaaatatggcagtttagctgggaagagattatttttagctgctgggcaggaagctgttgagtataaaatgcagggctactgaaggatttcaacacaaaagggacataatgaaagctatgcttttaggaaaataaaactgtgatccatgagtatgagggcctggaagaagaaaagacttgaggtggaaaggccaatgtagaggggcctacaggaatgtgcagggcaggcattgacggctggagctggggtagtggcatggggacggagaagctgacagagaccctgtagaagcagaacaggtagagcagtgggtatggaagtcaagttgactgcaagagtttaacctgaatggctaacaggccgtgggggtctcatgaagagaaataggaaagctgggagaagaagggaatatgggggcggaagtgcaggcacagaatatgaggccctggtgagatgcacaggggcactgggagtttaagttcaagaaggaagtcagagccccatgcagaagcagcttcaaaagctcagggtgggaggagacgggctacggctgagtgttcggtgagaaaggggaggagcagcaaatgtagaaacatcggtcacatggactgacgatgaagaaagaagagagacgtcaggacaggttaaaggggcggaaggagccagagaaagtctagcagaggataaaggagccaatgttcatagaccaacgggcagactccagtggagcagagagaaagaaaatgcatgagagagaaaggaacaaccaatgcaaccaaagtatgctggcggaaggccaccggagtccaaagagaggggagcttagagagaatgaccttttctccagcagagaaagcagagcaggaaagcagttgtggaagcagaactgattgacaacctccagctgtctttgcacctttggattcacccagcattcattgcaggtcatgctgctcccaggctgttccaggcgatgactgagcacggcaaagtgctagaactgcaccattccaccctcaaccccatgggactcctctaacaggcaacgtttgctcaaggactcctccgtggcctggctgagatgtaaagaaagaaggagagaatcaagaaacctacagatacggagcagggaggtgaggaatacttagggagttcatgagggaaggctacgtccagaaaacagcaagagtgtgggtgtaatgaaaggagaacagggttgcaataaagactgtgagaaatgaaatcaatggaaagagaaagttaaatacaccaaggaaccctgaggaccacctgatcttggagaacacacaaatggtgcatcagttggattggttgtatgattttctttctttctcttttttttttttttgagatggagtctcgctctgtcacccaggctggagtgcagtggcatgatctcggctcactgcaagctccgcctctcaggttcacgccattctcctgcctcagcctccctagtagcagggactacaggcgcctgccaccacgcccggctaattttttttttgtatttttagtagagaaggggtttcaccgggttaactaggatggtcttgatctcctgacctcgtgacccacccacctcggcctcccaaagtgctgggattacaggcatgagccaccacacccagccggttctacgattttctttataatgcactgtgtaggcaaggagcagagacagaagacacagagtggatgtcactctggtttgggagattgattatgtggccaacagagggagaaggagttaaggtccttaaaaggcaggttagaaatgcaagaagactaagagaaaaaaaattgcctgctaatactggccttggaggtgtccagttcaaatctccatctaagataagctgctctggaagcagagctgattggcagcctgcagttgtctttgcacatttggatccatccagcattcattccaggccacgccactcccagcctgttccaggtaatgactgagaacagtgggggtaccagaactgcagcattccattcccaaccctgtgggactcctctaacaggcaatggttgcttggggacttctcattggcccaggtgagatttttctctgaattacatacacatggtctgaggcacttcttaccggatccatccttcccactatcctttcacaggtgttggacttgtgtagcaggttgaagctctccctgcccactccagcgccctttcactttatgattcactgtaaatttcctgcaatacatctcttgcatgtctaattgttttggcttctgcttgttggaggttctgaactgacacaactggaattgctaataattcatggaggggttagtaactgaaaagtgtagtcagtgaggtgtgactacaaagatgtgaggctgatgggaaagaatcatgggattcttttttgaaataatgatagattcacaggaagttgcaaaaatagtacagaatcccctatactcttcacccagcttcctccaatggcagcatcttatataagtctagaaggatattaaaaccaagaaattgacatcgatgtaatattcacaaccagtttatatgattttatgcaatcagattctcatcatgtttttgtctcatagaaatattgatctcatcttcattgcaaaaagtcacttaagtaatagtttatttctaagtaaactagctctataactgcaaggtttgtaagacacataaataaagctgcaggtggaaggggaaatagaatatgagagatgtctactgaggaaagaggtctccatccacctgtttatctatccatccatccatccatccatccacccacccaccatccatccatccatccacccatccatccatgtttgctaagcctttccctagtgtcaggaactatgcactttctattgcactgagatacgaacatcaaaatggtagcagcagctattgtacttctgtttgggcccagatgcaatgaggaatcagggtgactagccggcaaagaatatccagatcagtcctgagattgtttccacattggcagtaattcaactgatagcaaccttatgctcaacggctaggatcatacctttttatgagtcattgtaaagtgccaagggcgttgacatatacttcataaatgctaaatgataacaagccagtgaacctagaagtattggattcagtatttgagacattaaatccaagttatgctgttctagaaacaaggtaaacaaataaatcaaccccaaatcaaataaagcccacatccatccccagccagcactgggtgttgtatggaatgctctttatgggtgagtggttatctcatgaaggggcacttgttagtattttacctgacagatcacacacaatgccttgcctgtgatttgggagaagagttttatatccagtccacagtagacaacagcaacactatattcttaaggctccaattccctttatttgatgccagaaaataatgtctgctgaagccctggagaagagtaacagtcaccccactgagcaattagactgatcctggcagggagtctctgtaggcagtactgggagacactgtttgtatttcaaagccaggatttagttttccttaaagacgtaagtctttttaggggtccctgtgattccttgagggtttaggcacacaatctgcaaagcctgaaatgccacataatcctgtactggctactgaactggatacagcatggtctgagtggttttctgattcacagcccagagctctgaacatggcctggtgctgtttgatctggggtctctgggcatggccccttctctctaggagtctgccgtcttggttgcacatacaaacatgatttcctaggactcacattcccttagtcatttcacagtgatgacaccctgaggagcaaagcccaactttacatagcaaaatagcgacggcaaagctcattgcaaattaggaggcgatgaccatgacatctcagggagtgacacagactgacaagatcacgctcgaacatcgtctaggaggagatgccattcttcagtggtcacttccaaaacaattttgctgtcattcaattgcagtcaagggaggcagagccaatgagcctacaccagacaactagatctgccaatgaagtatcgagtagaggactacagagccaggaatcaaaaggtaatacagccatcagatgctgaccttgctacattttctacaaatagaagatgattctatttgtagtttctgccagtttctgcatggtgcaggcctagctcatcacgttttatagaattgaatgtacatgtgaacaataggatgttttcaatgtttacgatggcggttctcaaatattactgagcatcccaatcacctggagacttcaaaaaaagcagatttctgttctacaacctcagagattctgacttggtagatctgggatgaggaagtttttagcaggcactccagtgatgggagcagatggcctgtccaccatgcttttggaaatcattgctttaaatcagtgtttctcagtctttgcaagggtgcaatgtaaagagtttagggaaataccttcaaaataatccagtttgaatttcttattttgcagatgaaaaaactgagggatcaagtaactttctcaaggtcactcagtcacaagtacaaagttaggatgataagcaacatttaatcatagtgccctttgtaccatttcatttggtgaatctcctctccatcaagtcctgttggacatgtacacaagtaagtaggaactagaatgcatttggattatcatccaaatgcattataatgatactatctaaattataatataattataatgatgtggataatttttatatcattgaaacaactggtgagaacttcagtgttgccaaaacaaacactagaaaaaatgaattcagaaagaaacggcacctaccttctccaaatcgagggtgaagatgaagatagcaaggactcaaagttgtcctgttaacaagcacaacgtctgggttccccaaatcagagtctataacaaagcaaaaagtaaatagtttcaaaaaactatttttggtacatattcctgatactgtatcaaaacaacagtacatgctttccacaagctgttctagagtcaaactagattgaggtgttataaatatggtcatcatttctaggtcaatacctcacttgactttgtgtcgccattgtcagtttaagctgaagagttctgtgtctcagcaaatttcagatgtgtcttgacaagggccattggaagattagcccatggacttgactctgaattgttataatagaagaccccctcagacatgggatatgaagctctgagaacttctgactcatttgtttggatcccctgttagaagagagtgaaaactgaatacaacctcatttcaaatgaatgggaagtcagagaaggcaagccaagaagagtgactaggtctttatgatttcagagtttgtatttgtactcattgatgggttgattgattgactcattcattcattcaagaacgatttatgaaaacttttcgtgagctaagcagttcttctattcagtaagatggtaggttttacccaatgtgaaactgattggctgaaaggagggtaaatacccataattagttattaatcctataataatttagaagaaaggccaaggcctaacaaccttacaggttggttatacaggcaagagcacttaagtgggagtaaagtggcctgggtcaagttctgggagaccttcggctataggaaggtttctcaacttcaacagtagatacttgtgactgaataaatattttttgggtgtgtgggctgtcctgtgcactgtaaaatgtttagcagcatttctggcctccagatgccagtagcatctccccaccctccagttatgacaaccaaacaggtctccagattttgccaaatgtccccattaagaaccactggagtacagtagtaactactattttttaagcaccttttaggggcattgtgccagggtttaatatatatcttcacattcagtcttgacaccagcttttcaaacaagcattcttatttctattcaaaacatggtgaaactaaggtccagagatgttaagggaatcatccaatatcacacaattggcaagcattggaaaagatttgagcccagaattatttgacttcaaggcttatattcatcgttccctattattttgctatgacatatatatatatatatatatttgttttctgagacagggtctcgctctgtctcccaggttggagtgcagtggtgcaatctcggctcactgcaagctgcacctcccgggttcacgccattctcctgcctcagcctcccgagtaactgggactacaggcgcccaccaccacacctggctaattttttgtatttttagtagagaagaggtttcacatgttagccaggatggtctcgatctcctgacctcgtgatccgcccacctcagcctcccaaagtgctgggattacaggcgtgagccaccgcacccggccactatgacatattttaagcatttggaaaagtacagagaataacctaataaagacctatatatttagaactccattttgatcactgctaatattttctccctttgctttatatctatgcttttggacaataaaatggtataaatgagatggatctttcttttagactttctcaattctttctctctcacttcttcccccaaataaccattctactgagattgctgccatgccgttcccgggtaagagtttacattttcttacatgtacctgagtagtctcataaataatatatagcacttgaagaaaactacataaaagtacaaattcttgtgcaatctgttttctttaaactcaacgttaagtttttgagttttttctatgttggagctacggtttcaattcctttattttaactgtgtgagaataaatataccacaatggcttgacatttaggttgtctcctgtttttcactgttacaagtcacagcgcggggaacatgactgtgtatgtgtgtgtgtacacacgtgtgagcgtttccctaggaaacacagctagatgtgggattcctgggttgcaggatgtgcatgtcttcaactttattagatattgctaaattgctctccaaaatgattgtactaaattacactccctccaacacactgtaagattattcatttcttcacatccttgccaacgttcggtattttcaaactttataatgtttgccagtctgattggggtgaaatagcatataattattgtttcaaaagcctatgttcttaaccactactcttactgtctacgcttcttgaagcttcagttatgtaaaatggagaaaatacctttttcgatttcttggagtagtaataaattctcctggtgtaatatacgaatgcattttgtaaatatgaagtgccacctttgttcattgctggcagtggcagagaaaatgtgcagtttctatagcaggcaatttgatgaaatctatcaaaatttcaaatgcacatgtattttctttgaacgtaaaaaaataatttcaaaattatagaaaaggtgcaaaaatagtgaagagaatttctatatacccagattgtctaaacattaacattttaatcacatttgaattataatatttatgtgcatgtatattatatgcacacgcattatttttccaatgatgttaactctgacaattttctataaacattctgctaaataaccatggaaaagttgtcaaaatcaagaaattaacattgctataataccattacctaatttgtatatcttatccaaattttttcaactgctttactattgtccttaaccgtaaaataaattttttttttcctttcccaggatccaatctaagatcattcattgtactgagttgtcaagtctcttcaatttcatttagcatggaataattctttagtcctttttttctctttcaggaccttgacatttttgaagagcgctggtgagttattttgaagaatatccctcattttaggtttgtctgatgtttcctcatgattagattcagggtatgcatttttgacaaaaataacatggaattgacgttatgtgcaccatatgtcagtttgtcccaatactggtgatgccatttcgattgcttggttagagtggtgtctgctaggtttctattgtcctttttgtaattggtaagtatctttttgggagatattttgagactctggaaatatcctgtttatatcagcatggactcatggatttaatgagttatactgtgctactatcgatgtttattttgatgcacgcttggccagttgggaccccttcattcttgctcctgatgtgtgtcttctgacatgtccccatttttccgtgagcatttccttactttctggcacagtaagatgtcccaggttcatcttctgttttcccagcttctgtcctggaatgggccattttccattgaagtagagaatagtatttagaaaccaagatccgggtgctaggcatgttctttgttagtggtgcacctatctggtttttttttttttttttttttttttttgagatggagctttgctcttgccgcccaggctggagtgcagtcttggctcactgcaacctccgcctcccgggtttaaacaattctcctgcctcagcctcccgagtggctgggattacaggcgcccaccaccatacccggctaatttttatatttttagtagagacgggggtttcaccatgttgggcaggctggtctcgaactcctgacctcaggtgatccacctgccttggcctcccaaagtgctgggattacaggcatgagccactgcgcccagcctatgcacctaacttttaacctagcaatttctctttcaagaattcttgcagcagatatgcccacacacttgttaaaggatttatgtgcaaggttattaactgcagcattatataggatagcaaaagattagacataacctaaagatctattaataggagactggttctataaattatttgaatccatacagtggaatattatgtatccataaaagattaataaattgcttcaaaaatatattgttaaactaaaaaaaatacaactttgtgtctagtgtgttaccatttgtgcactactaaaaggagaaatatatatacagttacaggtatatgtctatatgcttgctgataagtgcataaaatatctctggaaaaatgcacaagaagccaaaaacattgactgtggggaagaggattgggtagcatggggaacagagggaagatgatgtttactatgaactttgttgtaccatttaaatttgggactatatgaagtattaaaaataaaatactataaaacataaaataaatatagcattaataaagcattattttaacctaaggtattcattgagaactcaaatatcagaaggggaattctgttttccaagaaaattggctagctaaaagtgaaactccaatttgatcactattcctttgtataaatataaacattcctgtgattgttttttttttttttttttttttttaggacagagtttcactcttgttgcccaggctggagtgcaacagcacaatctcggctcaccgcaacttccgcctcccgggttcaagtgattctcctgcctcagcctcttgagtagctgggattacagggatgcaccaccacgctcggcgaattttttatttttagcagagacggggtttcttcatgttggtcagactggtctcaaactcctgacctcaggtgatccacccaccttggtctcccaaagtgctgggattacaggcgtgagctacggcacccagccctgtgattcttttatgacttaacttctccatctgtaatacggtataataacatcactaacccatatagcagagaaaatgaaactgaagcagtagaaataagagaagcagtctaaaaacacaaagtgccaggctactgtgactattaataatgccacattttcacatttaagtgaatttaatcaatatttgtgaatgaaagaatgaatggatggatgggtaaagttataggagaacaaagatgggaggagaattaggttgaattgcttgagtttcaagaaaaaccttttaaaagcacaggaataaatttaaggagcagacttaaggtagatagattgttttaatgcattttgtgatcccatacttcacataagaattgtgatactccagggaagcaacacagcctagcagctgatgccatggcttttagagtcaggaaacttacactgatagtccaactctgccacactagttgtgtgacctggagcaagttacaagttattcaacctctatctgcctcagtttcctctagagctagaagggttctcagaggtgatctaatatgtgtctcttattttccagatgatgagacaaggtaaaaaaagggcttgaggagacaaagtggttgcccaaggtggcatcatcaaccagaagcagatttggccctagaacataggaggtagattgcagacaggcacaaattccttgcagctcctcttatcaagaaaaagagtgtttttctctacccctttaacgtagtgaaaatgaagttgtgtgagagtcaagcctggattgtaaggggtctttgagtttccttctgctcctctcactcttggaatgctgctgccatgtgaaaaaaaccggggttagtctgtgggaggatgagagactacatggagcagagacaagaatccccgaggaagccctcccatgccaatcagctggccgactgccagacatgtgagtgaggggccccagagctcccagccccaaccaagccaccagcaggctacagaaacccaccgagttggttcagattagaagagctaccctagccatccagccatcccagccaccccaaggaaccatgagataaatcaataaaatgcttgttgttttaagtctggagtgtttgttacacagcgaaagctaactgataacaaacccaatgatagcctcttttcaatgaaactacatttacaattcactttcaggaagtccttttttttttttttaatttagagacagagtcttactctgtcacccagattagagggcagtcactacagcctcaacctcttaggttcaaatgatcctcccacctcagcctcctgagtagctaggactacaggcaaatgccactaaacttggctaacttatttttattttcattttttaagagatgggggtcacagtatgttacccaggctgatcttgaactcctagcctcaagtgatcctcctgcctcggcctcccagactgttgggattacaggcgtaagccactgtgcccagcctctaggaagtcttgggtgaccaattctccacctagattgactgtctctccctacccacatgttgcctggtccatgtccctctcctcccagaagcagcttctgtttctgcctgtgatcctacaaatggagggataaatgtatgacctccagagtcacagaccatcgtccttctgcagcagcagcaagagagattggtacaggacccagagagctgctagttgcaggagtcctcctgtcccacctcttacttcacagactctagacccctgttactgggtatgccaactacactattattaaattattcaggattaaaaggaaaggtgcttatctggcactggctggaaggtgctaagcaacagggaaagaacatcctataaaaatgagagccctgatggccaggcgcagtggctcacgcctgtaatcccagcactttgggaggcccaggagggcagatcacttgaggtcagcagttcaagaccagcctcaccaacatggctaaaccccgtccctaccaaaaatacataaatcagccaggcgtggtggcagacgcctgtggtcccagctacttgggagactgaggcatgagaatagcttgaacccgggaggcaggggctgcagtgagctgagatcataccactgcactccagcctgggcaacagagcaagactctatctgcggggaaaaaagggcctgggagtgagtttcttgagtatcagatttccaagtattcattccccctcttctttttatccctcatttcccttttccttggcttccattaatattttctttcctgttccctcaaggtatccgtattcatttccagaaataaatgaagggtttcctggtttccattaaatttaatgcccatatcctctactcattccccttccttccaactttaggagtcttttcatttttctcttttacaactttccccacaactgccctcatataggagattctagaaatgccaggctcctgatgaatgccccaagattttcccaatcagaatcttaggaagttctgctactctattattatgaagagaccaaagacacatggacaaaggaacaaccgactttttttttttttagttttttatttctatatatttggggaacgggtggtatttggttacatgggcaagttctttagccgtgatttgtgagatttcagtgcacccatcactcaagcagtatacagtgaacccagtttctagtcctttatctcttacatccttcccaagctttccccctgagtccccaaagtccattgtatcattcttatgcctttgcatcctcagagcttagctctcacttatgaatgagaacaatgtttggttttccattcttgagttacttcacttagagtaataatctccaatcccatccaggttgctgtgaatgccattaattcattcctttttatggctgagtagtattccattttacatatatatatatgtgtgtatatatgtgtatatatatgtgtgtattatatatatatatagcacctcagtgcatatatatatatatatataacacctcagcgcatatatataatagcacctcagcgcatatatgcgtgtgtgtgtgtgtgtgtgtgtgtgtgtgtgtatataacagtttatctacttgttgattaatgggcatttgggctggttccacatttttgcaactgtgaattgtgctgctataaacacacatgtgcaagtatctttttcgtctggtgacttcttgggaacacctgattgtggagacaagggcggaatcggctggggatctggaaatcctggggcggagcagcagtcatgaggaggagccatgctgatgggaggagccatgctggtgggaggagccagctggagtcagctttgctgcagttttcttcttgccagggctagtttctatgctgcctaacttggtgctggatacagttctcagaattccatcacccttgaactctgaaatggtgggggtttttttgtttgttttttgtgaatgctaattttctacccaggactcttggaataagctgagatgcattgaccacgcagtttggagcaaagtggtttcacccgttcccatctacctgtcgggcatttggtacttttgagaaatgctttagaagaggaatgaggaaatctgtgtcatcgcctggaaattctggtccatgacctcaacagccctcctggaatttccctggccagttttctgtcctaaatgcagatcacctacattaatagaagattctgggcatttgtataaaaatggctgcagcgattcacaacgttttgtttggtgatagaggagagcagttcaggctctattctatagggacattaaggtatgctggtcaaagcataaagggtcctgaagggaaaagcaagcattcccaaggagaataaggaaaatgtaaacagctaccaggcgtgggtgccatctgatcgatttcatcttccagcaggaatttcccaaacctgatcactttctccattgctaacagagagtagaggaaacacagcaatggggaagtccgtttcgaaaacaaaccacttactctttacagcaaagggactgaagtttttcaggagaaagatctagctgctctcccattcatcaaaatgtggcagggcagtgattacaaatgcaaatgtaacctttaggtcctataggcaaagacaatgctcaccgcctgtatccagtgggcagttgcgactgggttcttttctcaattctagtatttttataaacctatcatcacatattctgcatttatttgtgggtgggtatggaatgttactgctacacattttaaataattagtattagttaatatttagtttctatttagtatagtttatattatttctatttagtattactttcgaaagcaaacttacatacaagataacatctatacttcccttttgagattcaagaactaaatgaagagctaggaggtgccaggcatgacgagaggtgttagcatctggaatttttacaatgctactgtgaaggagtaatattcatccacatgtctccattttgcagacgtgaagacagattccaagcacttaaggggcttggccatgattagttggtgatgtggtttggctgcgtccccacccaaatctcatcttgaattgtagctttcacaattcccacatgtcataggagggaactggtgggaggtaactgaatcctgggaatggagcttttctgtgctgttctcatgatagtgaataagtctcaaaagatgtcacggttttataagcgggagtttccttccttgcccatgctctcttgccttctgccacataagatagggctttcgccttccgccatgattgtgaggcctccctagccatgtggaactgtgagtccattaaacttctttttctttataaattatccagttttgcgtatgtctttatcagcagcatgaaaacataccaatacacttgggtactgcaaggcagaaaggagatgtgaacctagatatattgactccaatcccagtatacattcaggatacacttgtagtcaagtgcatggtgataaaaaagcacaagcatgacctgtggtttgattacactttcgtgacagcctcagggctgtggtgtcactgaagagggaaaaatatctatggcagatacgtttgcctgggattagcggaagggcagaaggagaagggggttctgatgcatctttctgctgcatcaagcacttcactgaattgccatctctcccttgggcctgtggaatacacatttcctttgtaacttcatcttgggtctggggcacagggtcttgggggtcatcttgtttacacaggaaacacaaggcttcaaaatggccacccccaactatgatggaacagctaggtttcagcggggagagtacttccgactcggtttgaagaagtggaatttgggcatatggagtcgtccctgatgatgactaaccaggctcagatctgtatttatacagcatcccagtcttacaaattgaacatgtaccaaatcatggggcatttttatacaaaagggacgagcctcaatgacatccggtggtggtttccttgctacaggatgccttttccctcttgaaccctgaccacctgccatgaaacctttgcattctgtgacccctctgcctgccaaagccctccatgggcagcttggtctagcctggggtagccttgagaggtgactgggctagaccttgaggggacgctgggctagaccagtttatcccagtagattctcaaagactcagcattgctgtttccattcatctttaagatgatacgcaaattttcattaagtgaacttcttcctcattttatttttctccccagagtttgatgtttaactaaaggagaagtaattcagggccccaggatgtgtatttattttttcaatttgtgatgtcccctcatcaccgcctctcagtgtatctgttggtaaaaatggaaagtgatattagtgctattattaacctccatcgttatacttggaagatttcagaagatttgatttacccagtatttccatctctgtatggctatggtgataagtgggaagtcaagaagaaacacaaagtaggatgtgaataaatccatttttttccacaataaatgactgaaatcatactcttcttccttttttttccctagactagggttttgtaagaagcatggtggtatgagttaaacttggcctcaattggttttgcttgagcacaattattcccatatggagtaggaaattctctgttctgcagagttctgggggagatgctttagaatgtggtgcactattcccctcaaactctatatgaatctgaagaacagaacagaatgctgagtgcattgcaggggagagacaagggtgtgtggttgcccagttacccagcgagagtcacgtcccagaccctacccacaggagactgacatttagacaaacttgttctcagccactggcgctgcgcccgacgcagggcatggctctgaatggctctggcatctgttttgtcttgcctcaagcccacacactgggacttgcttgttttcatccaatagcaattagcaccgtggtaaatgccttgtgctctgtgctaattcagaagaataagcctgtcgcaactccgccaagaattacagctaatcacagagggctcggggcgcacctgccctttcatcagccttttgttttaaaatgaggggttggtgcaacccgaaacactgcattctctccttggtcagggataaccatggagacccaggggagacttggagtgcatcctggtggccatccctgggacatgcttcctacaaaggggcacagcgagcaacagggaacccaagcagctatttactgtgggcaactgcagacagggtgggccccggggacactccacagaggtgcagaagcttggtctacagcagtgcccaccaatggagactgttcacaagtcactgcagatgcagtacttgggaataaagacctgggctgcctccactttcaagctaaaaagctctttggttattgttttcttttagcctcatcatctaacctagaacctgggcttattctaagaatataccttctgtcctaatttggtattgatcatttattgatttttgtgctttttccttttaaagttaggtttgaaaaataacttacattcaggaaaattctcccctttaaagtgtatggatctatgagttttgacaaatgtcaacaggcacatcaccaccaccaccaccagggagccattggatggttcttttgtccctgaacattctttcttgtttgtttctcgtcagttacccttccctgcctccagcccaggaatctactgatctaatttttattcctattattctgctttttccacaatgccatataaatggaataattcagtattttttgttagcgacttctttcacttagtatgatgcctttgagatccatctatgttcccttgtgtatcagcagtttgttgttttattgttaagtggtatttcatggcacggatgtactgtagtttattttccagcaaatggacatctgggctgtttccaacttttagttattattaataaccttccacgaatattcatgtacatctttgtttgggtatatgtttttatttcttttgggtagatacctaggagggggattgcttggtccttcatcatatatttaactttacaagaaacttcccatatatttttcttttttgcttttctttatttttttttttgagacggagtctcactctgtcacccaggctggagtgcggtggcgtgatcttggctcactgcaacctctgccccctgagttcaagcgattctcctgcctcagtctccggagtagctggaataagaggtgtgcgccaccatgcctggctaattttttatttgtagtagagatggagtttcaccatgttggccagggtggtctcgaactcctgagctcaggtgatccactcacctcgggcttccaaagtgctgggattacaggtacgagccaccatgtccggcctgcccatatatttttcaacttgcattgctatcagcaacatatgcaaactaaaattgttcatccttgtcaacacttggtattggaagttttgaaaagtttagtcattctaataaggatctagaagtatctagttgtgattttagattgcattttcctaaggactaatgatactgagattcttttcaagttataatttatttaaaaaatcactttaaatctactctgctcaaattcatgttgaagacaggtctcatgcaacttattttagtgggaatttgtcaaatctctcccacgtgcttagaaacatgcagcccaggaagaggaaaacatagccacgaccactgatgtgcgtggagaacaggaactgctttatttaacttttcttccatgctgagctcatctcaggggaggaaccgagcctctccatcgcccacagcacccagcccagggtcaaacacaacagcaggtgcttcaataaatatttgatgattgactgaagcaagatggtggctcttgttcccagtggacatgactagggtttgtgcctgtctagtgggaggtgttagaacctagagagggctgattgaccacttactaaaagatctgcccagtggaaggcattcatggtatatggaggtcagcggtcccctatcaggctgctcattagaaccagggaaagagtttaaaaacatatggatgccctggaccagaggcggatttaccttgacactaatgagattcaagcttcaaggcctcaattgcatggtacccactgcgtgctgggaggtcctcggagttctagagtgttctaggtatggaggggaagaagccaggttgcaattagaacactcgaaaagatctctaaaccaagggatctgactaggtaatgtgtaacatttcttccctcattttaaagcaatactaagcatggaattttttaaattggtgatttcgttttgttctgtttttcattaagaagttctcacaaaacctggatctgcccctgctggatgtcaccccagaggttgtgatttaatttgtctggggtgtggcccaggccctggcaatttttagagcttggcgttgagtggaatatgccccagggttgagccacatggttacagtgtccactaatgaccaggtgtaggctacaagccaccgggaaagagcccagtcatgtgtgagcccttgtcattttaaacatcaactcttcaaccaaatgggccctttttgttttcttctaagtcagtcttcttgttttgagaccctccgatttcagtgtgtcccataggccatctccctgtggcacccactggcaggtcacaccccctgctcactcctccccagtggcttttcccgagccactggtgaaagcccaggctgctccggaggggcagcacagcaagctgtcaagagcttggggcagatgcttgagtccacactgcagccccgcttctgagtcagagggaactggatcagaatcccacctcggccactgaccagctttgtgcccctggacatgttccttaacctccctgtccctcagtttcttcacctgtaaaatggggatgataataggaacagctgtatagctttcaaatgaagatgaaacgagaggatggttaagtttctgctgcaggccaggagcatggcaggtgcctgacaaaggaggaattatgtcctggctgattgacacctacccgtcttctggtccaccctatgccatgcttcctgccctccaccgaactgccttccttctctgacaatgttttgtcttcactggccacattgctgatggggcattgtctcatcacctgcttctcttctcagttagatgctgggttcttagaggggagagacaaggttttacacccttctttccacagtggttgttccaaggcaacaatgtcatcatccacaaaataataatagctaacattttttgaatgtctgtttttcagacaagcaacccatacctcagggaggctgtataaccatctaagttcacacagcctatgggataacattcatccatgtcgaagttttcatccgtctgaagcaaaaatgagaaaagagcaggtagagctaaccgtatttatttaaaggactagcttttatttggagattatattactccctttttaaaaaattttaagtgctctttcactgacggcatgtgatagtgacagtaggttgcagatttttttaaatgactttacattgcaaaataaattattgagtattctatatttttctctcccagtttttttctggtaaaatgttattggtctttgaagtaaaaaaatctgagacctgttagtctgaaaaacagctgtatataaaatgatgctcaatctgtattggttaagtcaatacatatgacattttacattaactcctgacgcaaacttgttgccaatagaaggaaggaagagaaaatctttcagttcctaattcaatttctttccaccaatatttactgagcacctaacttgtaccaaggactgtgctagagtctatggacacaaaacaaataaaacacaaccgctgccctcaaagaacctagcgttattcccaacagtgaggttggagaaagtaaaaaggaacattgctgctagaataaccaatcaatatttcaacagaaatatcaatattgtaaaaatattcaatcaatatcaacatttgttaagggtatctttaatgcaatgttgttttttgagacagagtgttactctgtcgcccaggctggagcacagtggcgatgacatggttcactgcagccttaacctcctgggtttaagcaatcctcctgccttggcctcctacatagctgggactacaggcaggtgccatcacacctggctaatttttaaattttttgtagagatgggatctccctatgtttcctgggctggtcttgaactactgggctcaagtgatcctccagcctcagtctctcaaagtgctgagataacatgtgtgagccaccgtgcccagccaagggtgtcttttggcccttaaagaaaaataccactagacagggcacaatgcttctatttctccaccagtctttcagcccctaacgaggctaaactgataagggtgttctaatcctcatgtggtaacattcttggggttcacctgctacaaggaggaagtgcagatagcaataagacttctaacaaaaaagcatagatataagggctatggatcatttgaaaaacatttatgaaaatataaagaatattaaaatataaagaatgaaccaaaaacctacaatcaaaataactcctgttggatatgaaaataaaaagcatttcctcatgtggctagaaaattcaacttaaaaataggatggcataaaatgagttctgactccgctcagtaggccagctccatgtatctgttcagatgtattttccatgcatataccatcaaaatttatatataaaacacatataatacaatatacataatctgtccattttttcttttctttacgcaaaggactcatactgaaccacactcttctccacttctttttacttgaaaataaatcccagagatgtttccgcatcagttttttaagatctagccccctctttgtaaaggctatagagtattctatcagaggatattccatactttttttttaaagccaatctcccacttgccagatatttaatgtcttttgttacaaataatgccttaaggagtgtctctgtataggtatttcagtgtacttttaaggtatatctgcaaatttctacaggtggaatgctgcttagaagaatgtatgtatttaaatttgtaggccggatgcggtggctcacgcctgtaatcccagcactttgggaggccgaggcgggtggatcacccgaggtcaggagtttgagaccagcctggccaacatggtaaaaccccatctctactaaaaatacaaaaaattagctaggcatggtggtgcgcgcctgtaatcccagctactcgggaggctgaggcaggagaatcacttgaacccaggaggtggacgttgcagtgagctgagatcacaccactgcactccagcctgggtaactgagtgaaactctgtctcaggaaaaaaaaagtgtaatagttattaccaaattgccttgcaaaaaggtgcacaaatttgtattcctgtgaagaacggtggtgtaattctttgccagggatttgtgttctcaaacttttgcattttttccaatttgttagttgacttttgatatgacatctatgttttgcattgcttattttcatatttgtttggtcagcatttctttattggtttgtatacagtcaaacttactaatcttttcctttgtggcttctggtctttatctttgttttagaaagtgtgccctcttcagtatgctgagttcacttatgttctattctataactttcatgcttttgttactttaaagtctttgatccatttggaatttatttgggtttattgatgtcactttatttttcctcaaatgtttagccaggtgttccacactatttattaagtaattcatctattctttcctgacctgataccctatttttatgtttaagtctatgtctggattccacccatctgtttagttctttagcaataccaaattgctttaattattgttgcttcttaatctgttttgataatctaataggcacaacttactccattagacttccctacctcctccctgaagattccttgctattttgtatttatgccacagtaattaccagtattattttctgaactttctctaccaaaaggaaatgcctcttggaatgctataaatattctatatgacatctggtgtatatttcggatagataccctttattggtctaagaaactgtagttccctataaagctatgtccacaggcagtaagcaagcaagacttttgtctgtaatttttttttctgttttaaaacttgctttagcctctggattcaagcacagagatgtacagagcctgctaatttcccaccttttatgaagcacatttagtctatatcactgtgcagtagcccgattccaggttgccatttcctgtttcgggacagagagtctagaggtccctggctttagtctcacttgttactttgtatttgtgttccatttctggcccatagggaaatctatgacgcttttgagtccagttacatatttacctttctcttcctctattttacatgttagaacagagggggtgagtcaatgtgtgaatttaccatgccctcctgataggaaatctgtgtgtctgtatttccctcttaggttttcaaaaggagattctcagaatctagaagcatcacttgacgaagcttcgggtggtcatgactgctggggctcaggggacaagatcacatggtcgtctttcactagggggtcttttggaggtttgtttttacatctagaaactccaatatgttaaaatccccatgcataatcaagacttccactatatacctcagagatattctgagttcgattccagactgcctcaataaagtgagtagcacaataaagtgagtcacacaatctttttggttttccactgcatagaaaggttaatgtttatactgtcgtctattgagtgtgccatagcattatgttttaaagcccaatttaaaatactttattgctaacaaatgctgatgctgaatcatgaagggagcacatgctcttggaaaaactgtgcaaatacacttgcttgatgcagggttgccacaaatcttcaatttgtaaaaaatgcatatctgtgaagtgcagtaaagtgaagcacaataaaagaaggtatcctggtatatatttttgcttagccttacagtgagacttttgagctttattctatggaccgtatcctttgctccacacctaactcgaaagttaggggcggtcaagagtgatggggggggacagggaaggatgatattgggaacttattagaagatgaagcgtccatgccccatttttaaaactcttatcatttttcctacacaacaaattgtgtaatatgaattctctgatctagttggttgtgctgtttgtttagaaaactgggcattggaggggctgtatttcttttcttcctttttctttcttttttttttttttttcttttctgagacagagtttcgctcttgttacccaggctggagtgcaatggtgcgatctcagctcactgcaacctccacctcccgggttcaagcgattctcttgcctcagcctcccgagtagctgggattacaggtgcacatcaccagactggctaatttttggtatttttagtagagacggggtttcaccattttgcccaggctggttttgaacacttggcctcaagtgatctgcctgccttggcctctcaaagtgctgggatttacaggtgtgagccactgtgcccagccccagtggctgtatttcttacagtattgttacttacatggtacaggtttacataatattgaaaacaataaaatgtaaaaaaattatactcttccatttctttggttcttttaaaaatatttcctttttttagtgtatgtatttaaagtgtacaaaacgatgttttcctatatagagtgaaatggtgttttgagatcttaaatgtgaaatcttgtcatatttctgctgtggttattttcttattttttcaaaagtagaaatgctttcatattctcacaagggaaccacttaagacaaatgtcaaattttccatgaatgtgggaaatagtcgattacatgaggggaaaggatgtttgcggatgaggcaaacattccatcatatgggctaagtcaaactgtgacgtccttaaaactatcctctgccatgttcctttctaccttccaaggtttaggaggaatttctccccattagaacaggtcagacatggacaaaatgccatgttttctaaaggagatattctacagaaactgagaaactggttaatttacataatgcatttttgggtatcctgagttattttcattaaacgtactggcaagatccttaagaggagtgattctgcctcacactttaaaaaatgttctccaaaggacttgctatgggcttggcaaacacttgctgagttgacttacaaaacacggttggcatgatctcagcattttaatcatgacaaatctcagggctgacaaactgcatgttgatgtccttgttttctatcgaatgaaaatatttaattttcagaatgaactgaaagtcaccccgggtttacttaataccaaccttgcctcagatgacaaatcattctcaagggcagcactgtgtctccagaggcccagagcagggccaggctccctggattttagctctaggtgtcctcccatttttctttcttactgggtagatgaaatctttattaaaatccgaaagcatgatagtatttatcctcaggggctaccatttatagaggagaacaactccccaaattgtcgatgaattaaatcctcatgactttgtccgctttgtagatgtctcccaatgcaagcatttctgtctgtaggtcaccaatgtacctaataaagctggggaattcatcgctgaatattttctgattcactcatctttgaattcatctgctttgcttatggtggaaagagaaatgtctctgcatgagtccattctcgcattgctataatactcgggactgagtaatttttaaagaaaagaggtttagttggctcacggttctgcaggctgtacaggaaatatagtggttttggcttctgtggaggcctcaagaagcttccaatcatggtggaaggcaaagtgggagcaaggtgtcttacaaggcaggagcaagagagagaggcaggggagatgctacatacctttaaacaacaggatctcatgagaattcacttaatacctcaatgatattagcaaggggaatatctgccctcatgatccagtcacctcccaccaggccccacctccaacactggggattacaatttgacatgaaattcagtgaggacacagatctaaaccataccagtctatttaaatgtttgtgtccaaaagggaacatttttgggtacttttatcttttccattaatttggtaaatgatcatttaaacccaaggaagaagtttctcaaactaaataattatactgatattctcctaagttaaaataaagtttttgttactgttgttgtagcaaatctcttgttaatcaattttatcattagagtctcagacagtcaaaagtgtgagttaatcccagcgtgcatgtttttggtaaagtgtaacgatggaggaagaaagttgtggttgcttgcttgcttgtaatgtgtctggagttggttccttccactgggttcgtggtctcgctgacttcaagaatgaagccagggaccatcaaggtgagtgtcaacagctctaaagatggcacagacccaaagagtgagcagtagcaaggtttattgtgaagagcaaaagaacaaagcttccacactgtgtaaggggacctgagcgagtaggaggtgctggctggggtggccagcttttattcccttatctgtccccacccacgttccgtttttgtcctatcagagtgctcttttttcagtcctccctgctattggttacttttgggatcttgctgattggtgcgttttacagagcactgattggtgcattttacagggcactgataggtgcgttttacagagtgctgattggtgcattttacaatcctcttgctacagagcgctgattggtgcattttacaatccccttgctagctacagagtgctgattggtgcattttacaatcctcttgtaagacagaaaagttctccaagtcccctctcgacccaggaagtccagctggcttcacctctcagcaggagtgcttcaaaaaattttcacctgtcttctgttttttctactactaagtggggggcatccccatacttctcagttaaatgtaatacaacttcctttataatcttaaacttccggtctatgcattctttttgtaatctttacaaattacaatgctaatcatcttagggattttttttttctcaccttacagttaattcattttgcacaaattttaagctaggacagaagttttgacccaaggatcccatcaaaggtattggtttttccctccaaggagttttcagaaaactgagtcccagatagcaatcagatttttgttatcaaacatcccaaagactacgatatctgtcgtaagtaaaatacccataaattattgggtattttatcctactaggggtcagaagtatacagtgtatttacgttttatcatatattagggatctgaaagtgacatactattttatggctataaagaaaaaaagaatgagctcatattcaagggaacattgcattttttatattgagaaaataattttaagacaaaggtaatgaggaacccaatggaaattgctagtagactctctaaggtgtcaagtactgagtgattcttttgtctgtacatttctcatgtcttacatggcattgtaaaggcaatccggtcttttcgttcatgtggttttggatcttttcaacaatggcattattctttgtacttagaagcttggcaggcactagaacccatctttcaagcagaacaggctgaagacatgaggacatacagctgcagcttgaaggacgttgcacagaatattaaccctgcttctctcagaacagagtcttgcaactgagcaaatgaagcaatcagtagctccacaaataagacactgcaacaaattaaaaagtacctaagatgctcttgtagtctgtgataacaactatgcacgacagaaaggtttgtgaaaaacagatacatagactaatggagcagaatagagagcccagaaataaactcatgtatagatggtcaactaaattttaacaagagtaccaagaatacacaataggaaaatgacagtctcttcaataaatgatgttgggggaactggacacacacatgcaaaagaatgaaattggacccctgttggacaccatactaaaaaaatcaactcaaaatggattaaagacttaaatgtaagacctgacaccataacactcttagaagagaacataggggaaaagatccttgatattggatgtaacaccaaaaataccggcaacaaaagcaaaaataaacaagtgggactctatcaaactaaaatgcttctgcacagtaaaggaaacaatcaataaaatgaaaaggtaacctatagaatgggagaaaatatttgcaagccatatatctgataagagtttaatatccaaaatacattaaaaactcatacaactgaatagcaaaaaaatgcacaaatgacctgattgaaaaatgggcaaaggaactaagttgacatttctccaaagaagacatacaaataaccaatagacacaggaaaaggtgtttaccatcattaatcatcagggaaatgcaaatcaaaagcacaatgagatgtcatctcatgctagttagtatgactcatattttaaaaaaaaggcaagtgttggtgatgatgtggaaagaaggaaaaccttgtatattactggtgggactgtaaattggtacagccattatagaaaatagcatagaggtggccaggcatggtggctcacaaagttctgtatcccagaactttgggaggccgaggcaggcggattacctgaggttgggagttcaagaccaacttgaccaacatggagaaaccccatctctactaaaaatacaaaaaatgatagttaggcatggtggtgcatgcctgtcatcccagctacttgggaggctgaggcaggagaatcttttgaacctgggaggtagaggttgtggtgagccaagattgcgccattgcactccagcctgggcaacaagactgaaactccattaaaagaaagaaagagggaaatgaagggaaaggagaggagaggagaggggaggggaggggaggggaggggaggggaggagatagtataaaagtttctccaaaaagtaaacatacaactgccatgtggtccagcaatcccactactgaatatatattcataggaattgaaatcagtatgatggaaagatatctgcactctcatgttcattgcagcattctcaatagccaagatatgaaaacaatcataaatgtcaattgatagatgaatggatgaagaaatggtggtgtatatacacaatggaatattattcagccctaaaaaagagggaaaccctgccatttgtgacaccatggatgaacccagaggacactatgttaagtgaaataagcctgacacagatagacaaatattgtatgatattacttatatgtgaaaagcatagaagcagagagtagcatggtggttgcaggggctgggggaaggggaagactgggaagtgatggttacagggtacagagttgcagcctagtgcctatagctaaggctgtagctaacaatactgtgcctgtgcctatagctaacaatactgtattgtgtacttaaaattgctaagagggtacatcttacgttaagtgatcttaacaaaacaaacaacagtcataataaagggcatgggaggaaactttgagaggtgacagatatgtttataactttgatggtggtgagggtttcatggatgtttatttatccacaaactgatcaaaaggtatatattaaatatgcatagctttttatatgtcaatcatacctcaattaagcggtttaagaaaaacgaacaaacaaaaggcttgtgaaacacactaatcagagaatataaatatgatcaggggttacaggggcagcatacctgattactcggcctgttttggggccagacatggagataccaagtttagggacaaccaaatgagaattcattaagactcacagcacaaagctacctcaaaggaatccaaaacgccaaaatgacacataacatgaaaaaaactaattgcaattctaaagaaaactgaagtccgcgaattgtgtgtgcgcgtttgtgtgcatcttttatttttccagatatttgtttgcaaagttaacacagttttccctttgtatttttcccccactccacaggtgcatttcttgttcccagtcctaagtagcgtttacccccttttccatcagtaagcaatggttcggcaaagccaagaggttatctgatcttcatcctggaaggatggtgatcctttgctggtgacttgcattttctgcctagaaatctaaacaatttttctttgttttcaaggttaaaaattttaaccagaatatagcttaaggttagtatttctctacaagtctattattaacttgctttttatctgtaattctgttatctctttgttttagggaattcttttggctattctatctttgatggatttttcattggtgggttctctacttcaggaacatcaattgtctttatattgatcactttttgactgtcttccatattgattacattgtctcttgttgctttgtcttttgttttctgcactcactacgattaaattaagccttttctttatatcagaattttaatttagctaattgtatttcagtctttgctattctaatttatctatcagttcaatggtagtgttgttttagccctcagtttcttctttaactttgcagtctttcttttcttcttgtttcattgtttcataatgtttgatttcctttaaaatatgtatgttatttcattaacaacatgatgcggttgcataaaattgtcttcctttccttggcttatgttttcttccagattaagtccttcatttgtcatttttgtgttcaattttattcattcaatattgagttattgagcatctattatgtgtcaggcactattcttaatgttagggaaaagcctgttagggaaaccacattcctgccctcatggatatcacatctcagacagagaagtcaaacaacaaataaataaatctatactaaaacatcaagctggtcagtattttgggtttgtgaactcctggctaactgctcaactctcaacttctccattgccagtgccacgtaaaagcagccacagacaataggtaaactaatgagcgttgctgtgttccaagaaaactttgctgacacctgctttccggcaactgtttacatttaccgatgttattctcatcctcgttttggtattgctttctgaggtcattgcgcttactgatgttatgacaatgaggtataaagtccagtaaagagaaaaaaggatgatgaccatccccagggacacgtgttgagccctttccttcacttaacaattatttcaagaccaaggggaaagggtcattttggcctctcctggccatgatccatttctggttgtctgtatataagaacgtgaaggttggaatctgatactggcttcatcctgcaactctccaggcccgctactggggggactatcaactaatgggggacccagataataagaaaacatggacatccaccaatgaaagttccctaatggagtaagaggtcacaggcatgttgtaatgacacctgctgacttagtactgctcctactgcctgatttcttttacgaacatggtagacttaaacatttaagtgtcagcttatttttctaggccacgaaaatactttaaaaatacattttaaaattcttattaccagcctgggcaacatagtgagacattatctctactaaaagtgaaagaagaaaattagccaggcctggtggtgcatggttgtcatcccagctactccaggggcagaggcaggaggctcacttgagcccaggagttcgaattcgcaatgagatatgatcgtaccactgcactccagcctgggaaacagagtgagaccctgtctcaaaaaagccctcttattttaaaaaacagtttttattcactgcagaaacaaatgcggataggcaaagagaagaaaataaatatgatcctggccaggcgcggtggctcacgcctgtaaccccagcactttggggggccgaggcgggtggatcatgaggtcaagagttcaagaccagcctggacaagatggtgaaaccccacctctactaaaaatacaaaaattagctgggcacgggggcaggcgcctgtgatcccagctacacaggaggctaaggcgggagaactgcttgaactcggagggcagaggttgcagtgagatgagattgtgccactgcactccagcctgggcaacagagtgagactctgtctcaaaaaaaaaaaaaaaaaaaaaaagaaggaaaataaatatgatcctgaatccactatcctaagatgactaacgctaacatttctagatatattcttcaaaatataaatctataaaaatattaatatatgtgaaatgtattattataaactaaaacactaaaattaaaatggactcatattgaatatgtagcactttgcagccatcagtaagtaatagatgagagcaataacatatgtcaccgagtatgaaatactctcaaattggcctgctttataaactgctttttgctcttacgagaatatcatgaaaacttttataagtctctgttttttttgttttgttttgcttttgttttttgcaatggtcacatagtattccactgcacagatgtaccatgacttattcaaagagtctccccttgtttgggagtttactttgcttctattttttcaatattatgaccaacactgaaatgaatatcccttcacctaaataggcatatattcttttttttcccagggtgctttgtttttgttttgtttttaagacacggtctctccctgttgctcaggctggagagcactggtgtgatcagctcactgtaacctttaactcctgtgctcaatggatcctcctgtctcagcctcccaagtagctgagtctacaggcctgcaccagcacgcctggctaatgcttttataaaattttcttttttgtagagaaggagtctccctttgttgcccaggctagcagtttgcactgtgtaaaagaattcttctttacaaacatgctttacctcatttgggagctggcctcattctgtgttgaaaacttggttgcaacccttgagaaagggtggttctctttgctagttttggttgggtgggaggagaggtagacaaccctggattaggattaggatatcgatgctctgtgaggcagtgcccacaaggcgatgaggtccacataacaactcgaagagattaagggatcggtagagggtaattgtgtgagtcagaaatcccattgggaccattactacctaacaccaggagagcaccattaaaccattaaatgctaaaagtggcatgaaaaaaatccaaagggtgtcgtcagctgacaaagggcacaaaattcatactctgggttgacatttagcccttaacacaccatgacagcatgaggctctgtggggtgtgtcaggacgggggatctgaccaaactctcccctctcttgccatctgtggctctgcctcatgtactaatattacagaaacctctgcgtaaagaccatgaaatgcatattttttgacatatgaagcctcggctggtcatgtccgtcagggaaatatatcccaagatgggcggagctttcacatcttactcatatttacactttttatttaagccccctgttatttctctgagagtctaggatacagcaggctctggggaaataagtattgtaaagttggcaggtagaaggggtttttggctgttgtttttcaaacatattacacatatttttacattattaaaaacacacgcttccgcacaacaccatttccccagaagcctctctggctgactagtgtcaagcctggtgatttataagattgtttgcatatattatattttaaaacacatattgcttttgtaaaacgcgtatttattatacattttggaattcataatatgcgcagaaaagcagcctccgcctggctggatctgagacagtctgtcacgtaaacacatttctggaagggacttcatacaaatgctttagacggggccaaccaattcttccctccgcggctcccatggtctctccctccctctctctctctgtctctctctctcacacacacatgcccctctccccctcctcctgcacgtcacacccatacaaataaataataaaaacagtaatggaacaacggccccagaggaaagctctgttaggaataaacctgattttcaaagctgcacaaaaatcatcaagcaaagtaaccttgtgaaaagcaacaattcagaaccctatagattgggcggccccaaattagggaaatggctctgtgaaccccagtcaagtacgttcttcaaatacctcaagctgtgaccttaagtacaagacttgatttgaaatcaaattgtgtggttggtgtacgggaagagtgttccagaccccggtctccttggtaaggctgtgtgggtcggtgtgtggctgtgtgggtgtgtgcgttggtgtgtggctgtgtgggtctctgcgtagctgtgtgggtctctgcgtagctgtgtgggtgtgtgggtctgtgtgtagctgtgtgggtgtataggtttgtgtgtggctgtgtggatgtgtgggttggtgtgtgagtgtgagtgtgtgggtgtgtgggttcatgtgtggctgtgtggctgtgtgggttggtgtgtggctaagtgggttggtgtgtggctgtgtgggtcagtttgtggctgtgtgggttggtgtgtggctgtgtgggtcggtgtgtggctggtgagtcggtgtgtgggtgtgtggttgtgtgggtgtgtgggttggtgtgtggctgtgtaggtgtgtgggttggtatgtgtggctgtgtgggttggtgtgtggctatgtgggccagtgtgtggctgtgtgagtgtgggtcagcgtgtgggtgtgtgggtcagtgtgtggctatgtgggtttgtatgtggctgtgtgagtgtgtgggttgctgtgtggctgtacgggccagtgtgtggctgtgtgggtgtgtgggtaagtgtgtggctgtgtgagtgtgggtcagcgtgtcggtgtgttggttggtgtgtggctgtgtgagtgtgtgggttgctgtgtgggccagtgtgtgggtgtgtggtcagtgtatggctgtgtgggttggtgagtggctgtgtgggtcagtgtatgggtgtgtgggtgtgtaggccagtgtgtgggtgtgtgggtcagtgtgtggctgtgtggggtggtgtgtgggtgtgtgggccagtgtgtgggtggtgggtgtgtggctgtgtgggtcggtgggtgggtgtgtgggccagtgtgtgggtggtgggtgtgtggctgtgtggggtggtgtgtgggtgtgtgggccagtgtgtgggtggtgggtgtgtggctgtgtgggtcggtgtgtggctgtgtgggttgatgagtggctatgtggggtgatgtgtgcatgtgtggctgtgtgggtgtgtgggtcagtgtgtggctgtgtgggtcggtgtgtggctgtatgggttggtgagtggctgtgtgggtgtgtgggtcagtgtgtggctgtgtggattggtgtgtggctgtgtgggttggtgagtggctatgtgggttgatgtgtgcgtgtgtggctgtgtggctgtgtgggtcagtgtgtggctgtgtgggtcggtgtgtggctgtgtgggttggtgagtggctgtgtgggtgtgtgggtaagtgtgtgggtgtgtgggtcagtgtgtggctgtgtgggtcagtgtatggctgtgtgggttggtgagtggctgtgtgggtcagtgtgtggatgtgtgggttggtgtacggctgtgtgggtgtgagccggcagcaggctcatgaaaatccaggaaaacaaacatccccattcaggaggagccctcctccaagccttcttgctgtcccctccgttcctccctctcacaggatagagagcgtccccagcatctgggccggcggagatggactgcctgtgcccccattaatgctctgaccctgcacatttgctcttagccgttccatctcagcagggagccaaggaggagggtgggggtctggctctttatcagcctctcttgcctgtcaccccatggagggagggagggagggagagaagggggactttgggggctggggtggagaggtgggaaggagatggaaaaggagatgaaagcagccagaattatttctcaaataaaaatccggccaggggattgcaggctcccagtcccagacagaagctggacatccctccatgtggttctgtttctcgatcctgtcctattagcgtaaaaaggaaaaaggaaggccaggtgctgagacctccttgctgatgggcacttacaaaatggaagggacgagattgcacagacctgcccctgcactgatagctgaagacgcttttcttcacctacagaaaatgagaaccagcttggaaaaacaaaaaggccgtgcgtctaggctctgtgacttggtccagatgtgccaacttagcaactccccacgctgtccgcagcggagatggatttctttaacgttcctgttatcaagccctcctatttgtcgcccccaaactcagtttcccccagatgtcttggactgcttcgtttgaggcttctgcagcagctgctgccgctctacacaaaaggcggctccgagagccaagattatgtcttcagtgcattacgggcacatgcagtgcgtatatcttcggtaaataaccgcccgttttcacatggattatttagaatttctgatgaaactgcagaaatgtcaatgcggggtctaagccaccaatcggagagcggctccgcgacccctctcttcttcagcaagactgctattatcttcaaggggaaaaaaaaccctctttgtctcttgttataccttttttatgatctaggatgctgttaataacgactttgtgttacataaaacagataaattaatgtcaccaagtccccaaagtactgaatcaaccctactccttcaaaggaaagcagaaagtgtatgaactgaaggccaggactgaagaggggctcctctcctaaaatgggagaggtcctccaatcgctggcctgttcctatttgaaatgcaatatttaaaaaccgtgtggctggggaggaaaatgccgctgtctggctgaacatccctccaaaggggaaatcgagcgtgtggttttagttggtgatttaaagctcctgtaactcattatatgtgtgtgttcctgctccagccattcagagcaagggcagggtggggggaggtaggtggttccctcattagcaattactctacccttttggtggggatgtaagagggtgactcaaaacagcatcttcagggaagcccagctgtgtgttttcaaggtggggaaaaaacctggctttgcacgccatgtgaagagccccagatatgtatctctaacaggaggggacggggcacatgaaacatttctcagcagctcagaggtactgctctctaatccacagctgaggtcctaggctggcaatccaagccatgtccccagggcaccttgagtgccatccccaagcaggagctgcatcatcctttcctagtacacccgctctgcaaagccagtgtggctggtctcggtcctactggtcagtggtggctaaagagacaaaacaaccacccatttaccattctggtgagcccccaggggagcaggagaccctaccaggtgcaccgaaatgtggctacaaaccaggaatccaggagggagtgtgagagaaaggggatctgcagaaagccttgttgggtgggatgtccacaccaggccccctgtgtcaagtcacccggggcccctttgggatgcccccttcaggggtgctgaggaaaggtggtttctgagcctcaattccaatatgaagattataatgtggaagtgataggtattaattagagagaaataaccacacacacacacacacacacacacacacacacacatatagacatttatatacgaactaagaacataagctcatttctgtaaatcacaaggtttcaaacagtattcattgagtgctcgccatattccccagtgctaggcacaggggaatcaggaaggagtccaaatagactctgtgccttccctgatggagattatagcttcgtgaattccctaactgacagcccctaaccaaacgatgggaagtgagtataaaactgcagtgttcagcaccatgagaacctgagagagagactggaagctcatctgggaggtcaggaaagccccctcgaaaaaaacacactaaagctgagatggaaaagatgagttggcatgaagcaggtgaaaaggtgttctaggaagagggaagagcctgtgcaaaggccctggggtgggcaggggcctgtttaatgcaacagaaggaggatgccatggggtcctcagctaaaaatgttccaagcctgaagcctaacttgtaggtttcagcctagtaggtttccagaaggaatagaggtggacagggaagagaggtggaaaaggaccccaactgggtgtgggctcagagtgtgggactaatggtgagatgggtttcttctactatgctacatgtcacaaagctgcttgtctttcactgggagcctgctctcttccctggtgctttttgggtttcagtgtagatagaggaggaaagagccactaaggtgcttcgcagagccagcagcctctcaggctatttctcaagttcccagatagcttgggggcttagctgtgttgggagtagaattaaggaaccttggttagtgggataaattcctattcagagcaaagccatgaggatcttttgggagcaaatgggaaatgcagaacatagagaactagaaaacatggccttgggaaaaaacatcatgagaaccttctgaccagggctggtgatatctgcagcagatcaggagggcttagaagatgtaaaaccattagaaacacattctagccaatcaagttgacctcgcctgccacaacaaacccaatccaactaaaccccacagcacagaagtgcagtttgtgaagctgatgaccaagtgctctcagtgtctgtagagttatcccattctccttccaacggtacccatggtttaggcttcctgacaatcaaaccccacaccagctctgtatatgttcacctagacacgggccttccccatcttcatccccactgatgtctctggctgcctagggtacagctgggcccatggccatcatcaaagggaaggcaggggtgaggaattcggggagctgccagtgaaaaaaagctctcggagtttccaggttcttgaacattttctctggaatgaaggtttattggctccttgctggttatgagattatacgccagtcctccagagatacgtgtgaaggatcatgtaaatcccacattctggcagaaagagacaaacactaatttttacattaatgacatctcaacatggagttgctcaggagagcatctgctcacccctgattagaaagcctgaagtgtgaacagcatctgttctctcgcctctccctctctgtaatggacagccaccagaagaggtcttagcacctggtaagcaggtgtattgcccctgaaggaataggcaggtacctttaactatatgcattacctagaacctgtcatgagccatatggccatttctagaaggctggataggcttttgagaagatgcttttgatcattctacatgagagatctatataaactgccaaggttaatagggcctggcttgggggctgtctctgagtatgccacatattctgggaagaacttctgggtgctagtcacttggcaagcatctcacttttgtctttgtttgataatgttttatttacatttgtagaaatggtctggatagagctctctgtacctctcctctgggtaagcagagggcatgcctggaactgaagtttctaagtattgatattagtgaggttctgagatgccatgtaagaccatgttcaagttcattatgttacttatcttatagatagttgtatagattggggaggaaaccctaaaagcaaaaataaaacaaatcaaagggaaacactgcccatgttagaagacagaaggaaatttattattaacaagagaaagaagtggaatcagggcaggttaatgaccttggctgtgattagtgtcctttaccgagcacagcacagggtgtgacatgtgggtatagatatttctccagggtgatggctaggatgtctcaggcctgaagtaaaggcattcagagcctgcaaaggagttctgacattccctactccagggtgatggcccatggcagcattctgtggctttaacttccagcccaaatctagaaccccttgacattgtgagttattttatagaaatgccaggttttattttagtagaacacttctaggaggctaaaatgaaaactcaaaatatgtaaattctggaggtaacagaacaatcacctgaaaaaggatcttttatgtccatcagctcctttcaaatcttaaggtaaaacattttcctgaagcttctaagagaaattgcccagctcttcccttggtgcgaatgcttcctactgtgtgatgtgtgtgtgtgtggcgggagcgggcctcagggggtgcataagaaggggatggggttcttgatgggtcaccagggagagcctgaggccatggtgaggggtggcctcttgagcccaggtaggcttgattccaagacacatcagtcatctttgttctgttcatggactaaagctaggaggtattcctcgggctggaagcagaaactttctggtatgttccataggggacctacattttgaagaaggtagacagtctgctgacagttttggaagaagccaagtcaacacatctgggattcagagatggcatctaccatggaggcaagtggcctccagagagagcttgtcctaactgccttgaaacaaaagggaagagacactgtgcttgtctaaaggtagaaccaccttcaaacccggctgcgatgtgtgttttagaccaacctaccagaagaggaacacaggtttgcgtgaggagatggggatggggacaagaatcacatcagaggcagctgtgagaaaccactgcaagattagaatttttgagagagaatacctgggcaataccagagtcacagctggtaaaagtttgggaaagaggctatgaaggagactctgaaccccgctagaccaggaaataactccacaaagcccttcatgaagcacccaacaccaagagggtaaagactgactgatttgcaggaggagaactaggagtttccattgaaatttctaggaaggggattacaaatttaaatgaaagccaggaatcatcataaatggtactttcaagattttggtgcctgtaatgtccctgtagtttaattaactatcttctattctcctctattttctgctattggtgcatgaagacaatagtgagaagattcccccatggatctgggaatgaggaaaatgaattaaaggagtgtggattttgaagtttaactctttctgggcacagtcacttcaaagagacagactaaagcccaggccagcatggccatgcctgttggatgtaatagaagaacgtgtccatcagaagcatggtgggtcagggttgggcagcacagggcaaggtgattcacggaggtgggtaataagaaccattcactggagctgaagcagtattggagtattactggcaaagtcaacgtggataaagattcagtgagtgttgtccaaagacctcgaggatttggggtcattggcaagaacttccattgtacatttgtttcatccgttttactttgatcagattcaacgctcactagaaaacctttgcattattccttggctttctaagtcaatatgccaaaaaaaaaaaaaaaaaaaaaaaaaaaccacaaagctcagtattgaaactctgaaatatctagtttctggaaaagttattctcgctgtaaattaatacatttatagttcgattatgattttagtgacagagcttgttgtgttgggatatttatgacaattggatatatacagtactatacatttgtaaactgtccttttttatttcacaaatgtggttaagtgagtctgtccttgagaggaggaggtcccattcctggaaggtgggtgtcatcggtttcttagcctagaaggttgagaaccacatctgggaatatcataaaaccagccaggcgacagacatcacgctaagcctcaaagcctctcccaagataagcagcccctctcccccaggatggacatgctgttcatattgaagttttctacaaacaacagcaacgattcttaaaactataaagtggggggctggataatgtgcttattttggagacagtagaatacaagaagatggtgctcagtaacatagtttaaaaacaggcctgggggctgggcgaggtggctcacgcctgtaatcccattacttcgggaggccgagatgggcagatcacctgaggtcaggagcttgagaccagcctggccaacatggtgaaaccctgtctctactaaaaatacaaaaatttgccgggtgtggttgtgggtgcctgtaattccagctactcagggtggctgaggcaggagaatcacttgaacccgggaggcagaggttgcagtgagccaagaccgtaccactgcactccggcctgggcaacaaagtaagactccatctcaaaaaaaaaaaaaccaaaaaacaaaacagaagagctcatattggccatggaagaggcagaaatgtgaattcttacggttttctttcatggacggatattagtctcaacatccacagccacggctgggcgcggtgactcacgcctgtaatcccagcactttcggaggccgagacgggcggatcacgaggtcaggagatcgagaccatcctggctaacaaggtgaaaccaagtctttactaaaaatacaaaaaaaattagccaggcatggtggcaggtgcctgtagtctcagctactagggaggctgaggcaggagaatggcgtgaacccgggaggcggagcttgcagtgagctgagatcgcgccactgcactccagcctgggggacagagcaggactccgtctcaaaagaaacaaacaaacaaacatccacagccacgctcttcctgaatggccaactcttgacttttcaagcactgagccagttgggggacgattttgaatctctgcttctccctcttccaatgtcctgtttcctcactgtttagtgttagaaaacgaaacttggtagtggctgggcatttgctggtttggaaagagtatcgaatgtaaggtgtgaattttttaaaggtttaatttgtgcatttgtgcatttgttaaacatttctcattggctttgagaattaagctccaactacatttcagcacactttctgaacactgacaacctcttgcatgcgcaatctgcagaatttttagggttgcctggtttccatttgtagaactgggtaagaacgtttacgatgtcagcaagtccatttgattttcagttaatggcacagatgggaagctgctgtgaagcgcctgatggagggtcaccaggaaaaagaagggagtgggggcctgggctggacaggggatggatgagaaggcagtggctgccctttcacactttgtcaagggactggggggacaagggatggtaaggatggaagagatgcataagcaagaagaataggggacagagggagaccacatctctggctgggctttacccaacaggcacctcctctgcaggaagtagctttctccaatcctaccgtggaaaagccacctgtgtctcttgccccagttccaatggcaccagcaggaatggtgccccagccactgttggctccctggatggggtctaatggttcagccacagtccatgcatcatccccagggaaattcacagttctagccctttcattacaatcccgtgtgtgtgtgtgtgtgtgtgtgtgtgtgtgtgtctgtgtttcaaaccatcgtgtcctgacttttgcatattctgtttggaaataatgtaggcaattgtttcatattaacagctaactgcttatgaaatttcatttaagatacataactgaaaaagcataaaaatgtccaaactctctcatttaaaaacatcactacaagctaagaccttgtatgataatgggtaagtgcaatgttacaactgaattaagaaaatggcagaaataaattccatgaaggaaggatgggagaactttaatgggccttccatacccttgatgtggggaatgaatgttaaacagcagcatttccaggcctcactctggaaatatatccaaggacagtactgtcctaatatggtgataatctatgtgaatacaattagaaaattactctcttttagcaatatttaagattgacttgtacattacaaggcccaacaaatttactagacaacaattccgttaatggcttccttcttgcttttcactcctctattccccaatcccttattcagaaagatgtataaatagaattcacccccttgatctgttacctaagataggcagttacgtatttgatcatggttacaggtagattctttgcattcatttgtctaagacaaatactactaataatgatattgacaatgacaatgggaataaacaataacaaagtgacaataaagcacctatcatgggccatctactattcaaagggcttcagaagcatcctctcatttactttataattgccatgtgaagcaggaatttttttttttttttttttgagacggagtctctttctgtcacccaggctggagttcagtggcgctatctcggctcactgcaactctgcctcccaggttcatgccattctcctgcctcagcctccctagtagctgggactacaggcgcccaccaccctgcccggctaattttttgtatttttagtagagacagggtttcaccgtgttagccaggatggtctcgatcccctgacctcgtgatccgcccgcctaggcctcccaaagtgctgggattacaggcataagccactgcgccgagccagcaggaatgatgattaaccattttttaagatatggaaactgaggttaagaaaggctaagtaattgaccaaggttgccaagctcgcaagtggtggagccaagatgcaaacccaggtctcaaagcccacgtgtttaataatgaagagccctcttatgttcctggtgctgtagccactgactctaggacaaacctacatgtgtgttgaaaagcactgtccttccccagacagctggtaaccctgttatcttacatggacacagtaggagccctacaaacatgtatatttacaacaaatatccaacccctatttttagtcttatttataatgcagcttgagtaggtagacctggtaaatgtaggataaactattaaaggtagaagtaagccaaatccttctatccacaacctgcttgctttagcatgcaggagtcaaacgggacacatgtagccctgatacctcatggacttctcattttaaaagagaaacaagaaggagtgtaaggagaatgctgatgagctttggagatagggagaccaggttcaaatctgttcttttattacgtgaccttgggcaagttatagaacctctctgagcctccatttcttctctggaaagtgtctgtgcgataataaccttatcttgtagagttgttcagctgaataaatgagatagcacttagcacagttcctggcacataatgagaacataattcacattagactttgtccaggcttggtgactgacacctataatcccagtgctttgggaggctgaggggggaaggtcacttgaatccaggaatttgagaccagcctgggcaacataaccagaccctgtctctaaaaaaaataaataaataacaattagccaggcatggtggcatgtgcctataatactagcgacctgggaggctgaggtaggaggagtgcttgagtctaggagtttgaggttacagtgagctatgattgagtcactgtattccagcctgagtgagagagcaagaccctgtctctaacaacaacaacaacaaaaatcagaatttttttttttttttttatatggagcttgatctcagctcactgcaacctccgcccctcccaggttcaagcgattctcctgcctcagcctcccgagtagctgggattacaggtatgtgccaccatgcccggctaattttgtatttttagtagagatggggtttctccatgttggtcaaaccagtctcgaactcccgacctcaggtgctccgcctacctcagcctcccaaagtactgggattacaggtgtgagccactgcgcccaacctatttatgttgtcgtcgttttttttttttttttcacttctttaatcaacaattttaagagagactgttgttgattgtgtagagggcaataaggtagaaagctcacagagcatattttagacttctgggccttaccaagtggtgcagtggccagctgtgatgctcttaactgtgaggccaatggatggaggctgagctcagcaatgcgaactgatgggcttttactgagaatctccacttagacaggcatgggggcagggaagggagatgctgtaagcaaaagagaaactaacattccaggaatacctaccatatgtcagttaccacagtgaaaatttgtttcgttactgatagtgatgcctgacgtaaggtaaggtctctactttgcagagctgtggatacagtcagaacaatttcacttcagtttgtaaatgtatgaaaacaaaagctatgtgtatttcttaaagatctcaaacaacaccagtatctgtgcagacagggagaactacaaggggatgaagttccagaaaagggtgttcttactttctaatgtcaaaaagtctctaaactgactaattttctctctaaatataaattatgatgatgattattttacagactggggtccggttaccagcccctagagtcacatacagcatctgagccctactacaatagtccttagacaatctagtacaatctatacatttgaaacaaacattccttaatttattattgcagccagatattgaaataagttatagcatccgaacattgctgttcagcccctagaagagaaaaagcattttccagggacattttgcttggagttcataagagggtgaaataatgtaacaatagaatctctatccccagccacctcctgactaggcagttctacctccaacatcaaagctgctgcattaaaatttaatttgaatttaaaatccctgacagggcccaacactggggaagcaggggttaaccactgagataatgaggccatcgctgccaccgctgattctgttgacagtattgtatcacctaatgaatgtggcgatataaatcttgatgaggggcaggcctgagtctctggaaaagtaatgatcatgaggaagaggcaagagcccatgctgcagacgaagaggaaaaccaagaacgtgccccagcccaggaggagcaggctgagacctgggcccgcaaagggcaggctgactggccctgtttatttacccaaaatgccccatatttcatcgtgcaaatcatagggcctaccatgtttgcaggatttgacggaagcaaacaaaaggtaatgagaagcatgctatatgcttctaagtcaattctccactggcccagcaaagcagacctatgacaattaccaaaaacaattagggtagtctcatgatctctctctttcttctgtggcagaaagaaagcattttacaaatctgaatgatttgtgttctcatctgaagtctctactttattttgactgtgatggatagtaccatgaattgctttggcttttttcagttaacaagtttggtgtgattcctttgctactgttccttcccaaatgtgctccaagggctacttggcaagacaaaggacaaaaagtaaactaatcagctgggcatggtggtgtgcacctgtagtctcagctactcaggagactgaggcttgagcccagatggcttgagcccaggagtttaaggctgtggtcacctagaatgccccactgcacactagcctgggtgacagagtgagactctgtctcttaaaaaaaaaaaaaaaaaaaaggactccctgaaatgccccattatagaaaataaagattccatgaggccattataaggatgaggtttgatgtgtttcaaatagcatgtgaacacttcagcagcccctctggactctacctagaggacactgaggcataaagatgtcctgcaggtgtggcccataggtggccgtgtgtgccaggatacgggatgttgggagtctaacagccaagagtgctccttgactttttttttttttggacagaatctcactctgtcacccaggctggaatgcaatggtgtgatcttggcttattgcaacctctgctccccaggttcaggtgatgctcatgcctcagcctcccgcgaagctgggattacaggcgcctgccaccatgcccggctaatttttgtatttttagtagagacggagttttgccatgttggccaggctggtctcgaactcctgacctcaagcgatctgcccaccttggcctcccaaagtgttgggattacaggcatgagccaccatgcccagcctagtcctctttgactttgcagaccagtggtccaggctttacctgttccgaaagctgtgacattgggaggtgtccagcacattgatgctggagcagtctctgatctttggtggagaaggagactgatgttggagagctgataagatcggcctgcattgctgtgggctgtgtcagatgggtggaccctcctccaattctagaagtcaggaaatagatttctcactgaaagaaatctggacatgttcagcatctggacactcgatggcatcttgaagggaccagctatctttttccagaagtctcaaatctggttgtgtatcagagtcctttggataacttcaaaatagaaattcttggggccatccctacagaggttggtttaggaggacttgggcagttgtggcctggacataaggacatcctttgtctttcctttttattctcttatttttaaagaaacctcctagaggtgactatcatgtttctggcggaagaaggaaggattagaggtaaaagtgtggagcaaataggacagaaaaaaatgggaagtcaaacttcttcagagcttacatcagggtcactcaatcttggatctactgacatttcagacaggatgattttttactgtaggggctgtcttgtgcattgtaggatttctagcagcaaccctggcctctaccctccagatgcctactggaacctccatcagtcgtgccaatcaaaaacatctccagatactgccaaatgtcctctggacagggttagggggatacaaaattagccccagttgagaaccactggcctagacagtcctagaggccttgcaatgtgggcacctcaacaaggtcccgataccaagaaagagagaaagatcattgccaagtccctcatggcttaatgcaatgagccagtctttcacctcatgattatatttggaaaagaaacttgattccagctttttttttttttttgtgacaagcactcatttaagattctcttaacactaaagagaatcttgcagtgtgcataagcctttcttacggcttcaatctgatccggcaagagcatcctcaagcccctacctctgcaaagaagcggagatgaaacctggacaagggctgtgggtgctgcggcaaccacaaggcccgacagagtccatgcaagccacaaacccacgcaggtgcgccccaacctgtgcaccagccacacacggggacaccctcttctcattccaggtagtgttgaccaggaaaataaaaaaaaaatccccttttattaacaaagggagacagaagacaaaaggagcagaagatggaaatccttcaagatctgtcttagcagaagaaagctccctttctctttcttttccccctttctatgccctttctatttttcctctgtcttggttctctctttcctttgtatctttttcccttcctcccttctctttctcttctctctcatcccctccttccccctccctttctcctctctctctccctctcatttaaaaatccattcaattggcttgcccagcaaccttacagaaacttctctcaagagcagcctattgagactggctctcaaattgcccccagagcccactggatattccttcagatgtctaacaagcgttgaacacaactgaggtttagagagacacagaaatcaatactgcggcttccaccagtcacgctgagggattagttgtcccaaggaaaagcacagacagttgaataagagaatcatgactccgaataccctaacaggtttatgaactagagagcagcctctggccttgataacctccagttggcctggagaaaaaggaggctgtgaaaacattcacttagctttctccccttttgtattaatgaggtcaagcgtgggacctcagggagtcaacagtggtacttggaggaatgactgtcaaggccggtgggtgacgatgaccatctgagcagtggcattcagaggctctgagcatcctccttgctgtggagaagtcagtggccacatccctcaggacagagcttgcagggaggctagaactgagggcaaaatagaaaaacagcaatgccttggactatttgctttgagcaggtggcattaaactgtggcaggtgtttacatttttaaaatcatggatgggagagatcaacagagtatgcaaatgattaggggactctctaaatgggcaggattctgaaacagcaaagagcaatggagactttttttttttttgagacaggatcttgctctgttgcccagcctggagtacagtgatgtgatcatagtgcactgtcgccttaaactcctgggctcaagtgatcctcccacctcggcctccctagtagctaggactacaggcacacaccaccatgcctggtgaagttttaaattttattagggatggggtcttgctgtgttgcccaggctggtcttgaactcctagctccaagcaattctcccatctcagcctcccaaagagttggaattacaggtatgagccattatgttgggccgagcaatggaaaaatgttaacagcttctccactttgatgagaatataatgagagaaggctcatttcaatgtataaaaattctcatgctcctacttcctatgattcacattccggaggctgatcttacaattgacatggacattccaaacacctcacacaaataagacacctggttggagactcatttaaaaacagatggagccaacggcctcaatgatgtcagtctcaacaaaaagagaaaaagtcactttataactggatctctgggtttgagtgaagaattaaagctattatctgtataagtcaaaccaaaaacctaccttcctatgaatttataggacaatttaggtcctagctgaataattcagaaaaagataatcacctcaattatttagatggccatctcattcccttatatactccatctctctaacctggatgtggaaagtcgacagcaattaagtctcttaaccaagccaccaacaggaggccaccgatttggactacaaatgtggcaccctcgaaacaggatcagtggaaaccgaccaggattaagaaactgatttggaagacattggctctgaatcactaagtgatgctcacccaatctgatggaggttcaaaaaccctaggtggaaaaaaaaaaaaaaaaaaaaaaaaaaagaaatgtaggaaagtcatctctctgtgttgtgtatcctcaggttacctgctctacccttggtcctgcatagatgtcactgattctggaagagaggaattcagtgcccttctctggcagcctcccaccagtctcagcctcacggagcttgcagaagagcctcatttctggtctgtgtccaggttcagggtgtgagtcggaatttgtgcctccaaggctggttagccagcagcatgagaaatgatgtcatgtaaatagggcagatgaagagctgggagacccctgatgaagttcacaggggtcatgggaaaagagcccttcctctgggtgactttggaacaatagtgaggtcaaactggctggcggggctttgccatgctgtttctatctgggtggagacatacgcaccttgaggtccccgcgtgcctctgtgtgtttgtgtgcacgtgatcttatgcgcagagaggcagggttgtctgctgtgtccaggctggtggattcagctttcctttgtgcaagtattaatctgcccggtcccatcccccactctctccccgcacattagcctaaaatatgagcgcatgctcccgtctcgcctgtgttggctgctctagtgcccacagcatccctgcccccttcctccagccctcttatctaaagcagcatgtcactgcaattttatggccaacattacagactcaagccctcctttgaaccaatcaaactgcactaaatatgttaagggaatccaggcgttctgtaaggagcctgcttcctgagcccaccgcctgacctctctaagagcagcctccataaatctgcctcacctgatgggagatgggctttttaggatctctcagggtgctttgaggtagcacttctatgaactccttgccacaataaataatgctacctgcaatatgtctttgggagcatgtcagtagctgctgtcctgctatgaatttttattcttgtgccgtctggaagatagattccagattcagcatttccctgcacttactgtcagatctctttacccccttgccccagcagaatgacagagaccacaaataaaataaaataaaaaattaaaaaaaaaagcagcctaggaaaaatggcccaagatcggagagaaagagccaagctcacctcacagcagcggcatgagctgccaacatgaggcggggtggccaggtgggaggaaggtgggtgtaagctgggcaatttcagagtcctcaggacggaagcaattcaccaggggagcctggaggaaggggtctcttactaggtaatggtgtcagataagaagaaagcccaagtttgggtcaatacatcattatgaaggagagcaacagaaatctgttcacaaacatcagttaggtggtcattgccctggtaagataccgggcaatcagtccatgcaaagaggacggtggattcagaaatagcccagagatgacttccaaagtgagatgttatggtcagaaagatgaggaagaaagacacccctgcagcttaggaataacaatcagttgcttcccagatttcactaactcacatgtctttgctgatccagaagcgagcgctcacatggccgtgtgcattttcctagttatcagccctgcaacttcagaccaatcagcagacctgaagccaaaactcaccgatgcccaggaatttctgcttccttgtagtgccccaagttcctgggagtttctgcatttctaacttgccagctatatccattacggtgggcgaggtgcccaggaaaggaagaaagaaaagctggctttgatatgttaacatctcatgatggtagaatattttatgttataggccacttcctctttggagagggtacagttcagcatcctggcaggaaaagcacataggcctagcttctctgtgcatggagagccacacagtcacagactacaactttggcagacttttaaatgaaagttttgccaactgtgaaacagacaggaattacctggggatcttcaaatgcggattctggctcagtggaacccgcaagtctgcatttcttacaaaatctcaggtgacgctgacgcgacctgtggaccacacattaaggaatgaggttttaggttctaccaagtttctactgcgtacctactgttctactgcgtacctactgttctcctgccctagagtgtatatgtggctccaaacccaagagaacccagtctgtttctgttctcaaatagtttgttctttgttcttcatatcttaaaaaaatcaatatagatcaaaacagagttttaaaaattgtggtgatttgaatatctgcatttaacacatgaatacttgttttttgtttgttttgagacagagtcttgctgtgtcgcctaggctggagtgcagtggtgccatctcggctcactgtaacatccagctcccaggttcaagcaattctcctgcctcagcctcccatgtacctgggattacaggtgcccgccaccacactcagctgatttttgtattttttttggtagagatatggtttcaccatgttggccaggctggtctcaaacttctgacctcaaatgatccacctgccttggcctccgaaagtgctgggattggaggcgtgagccactgcatctggcccgcatgaatatttttcatgcctccaaatggaatatgccatctcacttggagatgatgacaagaatccatatttgaggttctctgtgagtgtaagatcaaggccaatttacctctgggcccagcagtgacaggctgctagaccctcccacagggaatcagatggtttatgcagaatgttggcttcatgcggtggccaatgttctacccacagccaatgctacgttatcatttctagcctcctggggcagtgtgatcaatttcccagcttagacattactgagagaagggtatagagttaggtgaaggctaaatgaaaaccttcactgatcaagttaccaatggtgggctggtaagtgggaccagttcatttcctacacaacaagaacagcaagaccacaaaactgacaacataaaatggaggtgataagatcactgacaaatgcctttttggatgataaagtctcttatggttaagatgatctttggagtaagaagtgcagaagcttttcatacatcccaacatgtttaaatacagtagctgaggagatagcagcccctgtccatcaagtcatctgaggccaaccatcgtacacatgatcactcatttgtaaactgggcttcctgcctgctgaatacctttgaaaaacagaagttctctcctaattgcctgggctgacctatatttagaaaactgaaatgtgctggtacagtggagaagccagaaaaatgttggagttaatcactaaatcaatctgggctgaccccatgaggatagtgagcactgaaggttgttggccaaggagcttttggaggctggacttaaaagaactctcttgtttctctgaaacgggaaaaactgcttctttctgcaaaaacatattctaggatagtccttcaaaacagtcacgccagtagccaagtcaaggttaacttcattttgttctggtgtacacaggtaggtaccacagctggagaaacaagagaaataggctcattctcaagaggaacccagcgaggagatctttcttttcttcccttctcacccttggccaactttccttctcttatatctgtttggtttcttactatcctgggttgttaaaattcacagttgaaattttccttaaaattttatacccacgaggtgatgataatttcctaaagttcagagtttgaaaaattgggggaaggcacaagaagtattcggcattattttcagattaaatgaactgtgggatgacatttggaaatgggcaccaggtaccttgaagatgagcaattgcctttacaggaacactgaacagaaagttcaggaagctccttaattctgtaggaccagcactcacccccaaatttgccagctcccgtgatttctgcaacctatgctaaatgatggcttgggtttgaaggctaaaggatataaacagccaaagagggggaaaaggcacttagaactagagagagttaccgatcatttgatttctgtagaaaatacttgtcggagagataagtaataaaaaatctagcacatattttgagatttaggtttggctgtctacctagttaaaagtttagattgagttatctgagccatatgcatgcatatatatatatatatatatatatatatatatatatatatatatatatatatatttatttatttatttttgagacagagtttcactcttgtcacccaggctggagtgcaatggcgcaatctctgctcactgccacttccacctcctgggttctccgctcaatgccacctccgcctcctgcctcagtctccctagtagctgcgattacaggcactcaccaccatgcctggctaatttttgtaattttagtagagaaggggtttcaccatgttttccagggtggtctcgaactcctgaccaggtgggagttcaccagatggtgatccacccaccttggcctcccaaagtggtgagattacaggtgtgagccaccacgcccagcctattttttaattctcgcattgaattttgtagtgctaagctaggaaatgaggaacttgattaagtagtgttacaatggaacaacttatgcatttatcgtcaacaatttattgagtgttttcagaaccatttttgagaagacatatgagtattagactttttttttcctgcaggaagtttacattcttaattgttgagatgggactaagttactaaaacatattatatatattatattaaaatatatcttaaaaatatatagatatgtaagttaagtacaaaattatatgacatgatatgatagggactacacaatcaagctaagaatttggagaagcagaattaccaatgaggaagttagatcccatgacaggcttcctcctggtagggtttatatagaaaacaagaaagggtgttccaagattgtggaacacagatgggaagctatgaagtttactattttttattatgattttttaatcttttattttaggtccagggctacatgtgcaggtttgttatatggtaaacttgtgtcatggggatctgttttatggactattttgtcatctgagtactaagcctagtaccccatagttgtttttttggatcctctcccttctcccaccctccactctcaggtagccccagtgtctctcgttcccctccttgtgtccatgtgttctcatcatttagctcccacttacaagtgagaacatgtgatatttcgttttctgtttctgtgttagttttctaaggatgatggcctctagctccattgatgttcctgcaaaggccataatctcattcttttttatggctgtgttgtatcccatgctgtatatgaaccacaatttctttatggagtttaatgtgcactcctgcaaggaaactagtccacagcagtggaaggaacccatgagggggttgtgggaaatgaaatttgatgatgtgggaagcgacagatgagagtggggtttgcccttgattagcagtaaaggaagatactgaaagttacttttaagcagaggagtattataatgggaacatgttttgacaaactggggcagggtctcagagcctcaggcatgtactctcaggaacttagagaagagagagttaagccctttgaatttgatccagcaggacaataatgcttaacagaggaacaagataattctgagtatagcctcagtatcctcaagtagtctgagacctgtgaggacaaaaatagcagtttagttaaaattctgtaaaactttaggaggcataaacatgctttgggactcgttttttcttgccttttttttttttttttttttgagatggagtctcactctgtaacccaggatggagtgcaatggagcaatctccgctcactgcaacctccacctcccaggttcaagcgattctcctgcctcagcctcctgagtagctgggattacaggtgcccaccaccacgcctggctcatttttgtatttttagtagagacagggtttcaccatattggccacactggtctcgaacacctgaccttgtgatctgcccgccttggactcccaaagtgctgggattacaggtgtgagccactgcacccggtctgctttgggactctttctaacagagacaatggcaaaaccatctgaggtggtggtggtggtggtggtgaaatgggagcattccaccctggcaggaaagctagttttattattgacattattagcacaggatgataagaaaaagtgaccaatttttagctggtttatgattgttgtaaaactctccactgacaatgcattcctttgctgtctgcactcggggtcactgctcttgctctctcctttcctgcatatgcaactgaagagacaaagaccagtagctctccatgggggcaattttacccccagggaaatttagtaatgtccagagacatttttttgttgtcacaactggggtggcagcagtgctgctgacatctaataggtagaggcaaaatatgctatagtacataggaccatcctcacaacaacgaattatccagtccaaaatgtcaatagtactgaggctcagaaactgatatacaccaaggtgctcaatgaagcattatttataacagcaaaattctggaaataatcctcatttctaacaataaaagaatcgttaaaaattattgattatcatatgtccacaggatgtactttgcagtcatgttttcaattataacttgatataggctcaccctgtaatattaaatgaaaaaaaaaagaatcaaagctgtgtatacatgcaatcccaattttgtaacaacaaatgcatcacacacatgtcataaacacaaacaccccagccaggtgcagtggctcacgcctgtaatcccagcaccttgcgaggccgaggcaggcggatcacctgaggtctggagtttgagtccagccaggccaacatggtgagaccctgtctttactaaaaatacaaaaattagccgggcatggtggcaggcgcctgtaatcccagctacttgggaggctgaggcaagagaattgtttgaacctgggaggcagaggttgcagagagccaagatcgcaccactgcaatccagactgggggacaagagagagacttcgtctccctccacaaaaaaaaacaaaaaacaaaaatacacaaacaaacaccccaagacagaggactgttaataagtaaccaaaatggatggatgcagtggctcacacctgtaatcccagcaccttgggaggccgaggcaggcagatcacctgaggtcagaagttcgagaccagcctggccaacatggtgaaaccttgtctctactaaaaatacaaaaattagccaggtggcagacgcttgtaatcccagctgctggggaagctgaggcacgagaatcatttaaacctgtgagacagaggttgcagtgagctgagattatgccacagcactccagcctgggcgacagagacatactccatctcaaaaaaaaaaaaaaaaaaaaaaagaagtcaccaaaaggccaacaatggttatctcttgattcgtagataaaaatgtttgttctcttctttgaacttttctatatttctgaaatacgataagcatgaattaattttctgatcaaatataatttttttccaaaacacctcagtgatttgaaacataggccaaacttaacaagacgaaatataattggaccgtgcaacatttacatataggttcaaagcatcaattgtcaaaggcaggagtaagatgcttttgcttatgacccatttatgtaaaaagggtgtgagtcaatggaagctcaaaatcaaacagaagagaactgatgaggttgctgaaagagtgatctaaacttaggacaccttaacaaaattttgcaccaggatgacgcatgcagcagtcctctgtggggcacttatctggactgctgaatgcagtggtgtgtgacgtattttaagggggctgttgaaaacctggagtaggtccagatgacagcaaccaaaataaggagcttgaaattgtgacacgtgacaaaaggatgaaggaagtagtaaggagcttgaaattgtgtcacgtgacaaaaggatgaaggaggttgggatgtttagtctgacgacaagaacacttaggagaggtgtgagagctatctttaaatatttggagggctgtcataaggagagggacatatgtgctgtgcatgggcccagaccacagagctggcactaatcactgatgagaactgatcacttatcttctttcacataacttccaaacacaaagaaaaaaaaaaactcttctaaatcttagagttgtccaaaaatagagtggctaacttgggaagtcatccagtcccgatcactgacttaatgatagtgtgtcaaggttgttgccgagaggacagtgggctgggaaaatgagagagcagcgatgctactcatacattcctggtgcctattgctcaatgcatgagcaaatgcagaggggtcaacattcattgagggctttcagtgggccatggaccaggaatggtgccaaatgcttcacacgctctgtccaacttgttcctcatagccaccttgcaagaaaggcacaactctacatttgcctcgttttccagatgaggaaatacaggctcagggaagtttaggggcatgctcaaggtcaacagctagttaatgtatcagattctacagcaatgccaataatagtaatagtaatcatcataactgtagttgcaaacatttgtataatgcgtactatgcatcagagttcaaaatgctatgcctctatcctcattttacagataagttttgggtaggtcaagaatcttgtccaaggccaaaaatgggtcagtgatatggtttggctctgtgtccaaacccaaacctcatgttgaattgtcatccccatgtgtcaggggacgggcctggtgggaggtgactggatcatgggggcagatttcccccttgctgttctcatgatagcgagttgtcccgagatctgatggtttaaaagtgtgtggcacctcccccttttctcgctctctctcctgctccgccatattaagacatgcttgctttcccttcaccttccaccatgactgtaagtttcctgaggcctcctaaccatgcttcctgtgtagcctgtggaactatgagtcaattaaacctttttttccttataaattacttagtcttgggtagttctttatagcagtatgagaacagacgaatacagccagattctgtagtaatgctaaaagagtaatagtcatcatcatcacaaccacagctgtaaacgctcgtatagtatgtactacgtgtcaaaaaacacagtttggaatgctgcacctatacaacttatttaccataacaccctaagggatgtctctcttattgtccctatttcatagatgagaaaatgtagactcgaggaggttgaagatcttgctcaaggtcacacagctaatgagcgatacacctgggttttaaaacctggcacttcagactccatagcggtattagtaacaatagaactaggaatcctcatcatcactgtcattttcccagtcataaaaatggcacaaacatgtacacagcccacactatgtgtcaggcaaacacagcagacctaggaggtagtatgatgcttaattttatgtgtcagcttggagagtggttttggatgagattaacatgtaaattggtaaacttcagtcagccacggtagctcacacctgtaatcccaacactttgggaggctgtggccggtggatctcttgaactcaggagttcgagaccagcttgggtaacgtggggaaaccccatttctacaaaaattagctggtcatggtggcacacacctgtagtcccagctccttgagaggctgaggtgggaggatggcttgagctcaggaggtggaggttgcagtgagccaagattataccactgcactccagcctgggcaacagagagagaccctgtctcaaaagaaaaaaaatctggtgagctttgagtaagcagttgtcctctttaagaggtgggtctcatctaatcagtggaaggcctgaatagaatagaaagataggcctccctgagcaagaggaaattttttagcaggttgtctttggacttcgtctgcactatcagcactcctgagtcttgagcctgctggccaaccctgcaaattttggacttcccagcctctatactcactccttgtgaaccagttccttacgataattctccttttctgcctgtacctttcctattggttctgtttttctgcagaaccctaaaataggtaggtacaactattatcctcattttaatgagagacccagagacattcaagaactgggtcaaagtcacatgactaataaatggcagagccgggatggaaactccaaccactgggctctgtagtccgtgctcctacatggcattctctggagctccttcctctcaactgctgtgtgtgttatgatctaggtgacatgaaatgaggggatgaaaaaggtaaactctcaaggcaggaaagttgctgttcacagagaaagaatgacatccctgagctgctcctcctaccaaatggccacttactcattcttccagatagcccttgccacattaggacatttcttaatatttgacagattgaagggtaaaagacccaacaacttttcttcctcctggtattgttcaattcaacagagaaagaatttactgagcaccttccactttcccataagttagaggcaactgtcttgtctcctgactcttgattctcattagataatttgtgatttgaatacagaatatgtaaaataattcaggctgggcgtgatggctcacgcctgtaattccagcactttgggaggctgaggcaggcggatcacctaaggtcaggagtttgataccagactggccaacgtagtgaaaccctgtctctactaaaaatacaaaaattagttggatgtggtggggtgcacctacaatcccagctagtcagggggctgaggcaggagaagcgcttgaacctgggagttgcagtgagcaccactgcactccagcctgggtgacaagagtgaaaactccatctcaaaaagaaaaaaaaaaaaaagaaaaaagagcatttaatatagttcaagtgacatataatgatacaatgcctcctcagcttcccctatgtggtggaaatgcacaagtactcacgttgttgccttttcaaagttttgaagccttgccctgatatcagcaatttctatagtaaagtttctaccttttagtttactatacctctcgctgataggaaaatcgctcttgatattctcagtttaatttcacttttgccagatttccattaataccggtatctctttggaccatccaaagccatcctcctctggaggcttatctttcacataatttccaaacaaaaagacaacacagacaaaagctgcacaaaaacatgccatgggaccaggtattgaaaaaaaaagacattgaaacagacccaaacagaaatacaatggttttattatatgagccttcagcggtaaagaagaaaggaaaaagcaaggttagcaaaagaggaaaggaaagcaaaatgactagcaaacgcaaagtgcctaaggagatggtgttttctttgtatgcatcaacatacactcaaagaatatttccctataagggtgtcattgcccactcacttcccgttttcagttatgtgtaagagaagcttttaactctattttcagcccccctgggagttgcaaggaagaaggtgttgctactaaagtaggcaatgctcagcctgaaagtcaaggatacacaagacgcatacccatcagcctcctcgtcctgcctggaccagccctccctgacctcttagtgggggttggaaaccgctggcccgcactggccagaccatggggagaggctctcagaggacagtgtctcctttgttggatgttttatcacaaagaaggtgataccacaggaaaaataaatccggaagcttctagtctaacccaaacctcaggtgttctagcaaagacagcaggagaaaaatccccattgcatatctctatcttgcagtataaccctgaggtcagtgaaggtcattgaggaaaaccaacctgaatgtagagaaaaagcagggtctctggcaatacaatttaaaggtgacaggacacgaggctttgtttccaggcacaggctgcctccctttcttgcagtggcagcccctccagacctgcccctttatgtccaccccaccctcacccccaacactcttgactgtccacaggtcatcacctatgctgggccttccccgttgctctcaactcacaatggactgttccttctctgacctcggatgatttaagtcatctctaccattcaacctaatacctagtagatactctttgatattcttttccaacggtttcatgtacacaggtcttttctaccaaataatattccatgtgccttgaaagaaaggatctcgtcttatacttgttgggaatcccccactccactagatctagtactttggtgacctcagcaaattcttgcgataaaatgcttgatttttatcacctccctacctatacttccaaacggttgctatacttaggccttcacattcacgctgcactcctgaccagtgaatgcaaacacacaaggcatcattttgcagaaaaatccggatatggtggagaaagaaattgtcatttctcaagattcttgatttgtttcttgagctaaggggagggaaatgcttgccagtgtttcctggctgattttggtatcatgctgttggcccttttgtgagatgtgtaaagacattttactcaatctgtgagaaactttgatacagacagaggaacttggagactagccaggcctctttttaataaacacaggagacgtgagatgggcaggtctagggtgatgggaagaggtgatactgaatttcatttcttagctatatacaagggaataagattattcttaagaggggggtgggtggtggtgaaaacaatacccaccatgatactgatgggcaggtctggttgtataactactgctgaggttcaggaagctcccaagatgagacttccatgttccagggccgctttccctttaaacagaagccggggggtggggtgggggtggcggtggtggtggttatggtattgttctggcttcagtattaatcttgctttcttcccacttgcacctgctaatgttacccggcagagtcacagccatcgctgggcccttcccccactctaagtttatttattgtggctattttaccagctattggctcaacacactatactcaaatattcatcatgtagctctctgggtaaatcgtatttaatcagcacaggagagaaaatagcataattatagatgccggatgccattacactcagaagaaattaaaccctgtctcaagccgaccagcggttgctgtgattgcatcactgctggggttatggagaggttagtggccattgggggccagcagtacctcgtaaggatgcctgacccagatgagccctaaggagacccactcatgcacatacacatgcgcggcatcaaatactcatcaaacggcggccagtaaattaatctttcattgtttggagaatgtgataaatgagagggataataaagccaggttcacgcatggagatgaagggatggcaaataaatgggcccagagaattccagtcctaaaagtggatagagggaattcccattcccaatctttcccagagcatttcttgccaatagccagagtgatactgacaattaaggcaaaggagggtgacaacctttacaatgaagcaaaagcatccatttgggttatgagtccttacagggaatcctcccagctacagaggataagaatgcaaatgccaaaccagaagtgcacattagtcctggtccttgccaggtagacttgagtgtctcacatgcaaaagtttccatgtcagtaatgccagtgagttgttttgctcggggaaatggagaaggtgaaaagttgcaaaaacaaaacaaaacaaaataaaaccccaaacccaaccataatataatatcagagccctacctgctgaaatgggctcctggaaaaagctggaaccatggggtcaattttcttccagccattctcggcccgacctcttcccacacacatccagggccacctgcacgtgtccaggtacagaattagagtcacctttaatctcacgacacagcttctctcccctggacctaaaccccaggtcagcaaccccatacagtgtagagcactgtttgtaaaaattcaaaaatgtccaaagatgcaattaggctttacttattactattgggtgactgtttttgcttttttttttctttattcctttttcttctggctaataatgcttctgaggtttggataagtaactaagaggaaggagatctccttctagtccatcctgctgccgacaattaagaaacctcaaagtaatttttgaaaatgtcagcgtctcatttagcaaaaggataaataataaatgaagcgtaatcactgtcctgtgctggtggtacagcttcgcggtgtcattagtaaactaacggtataatatctttgtgtcacagtttaattatatcttgtaattagtttcagcaatggattgcatagagtcaggccccctgagctaaacaaaaggtaatagaacttttcagcgcccctgcataaatcaattatgaaagtgtcctatgctatttgaagcttgtttgctgtaattttatgcacaaagcccaactggcccttcttgcttgtggagggctattcaccccaccccacacttgtctgcagctgagcctgcggtcggcccacacgcagcctggcccactggtgcatttctcaggaccagctcagcagtaaataccatggagggggtgaggtgctgaggggaggggaggggaggtgtggaatggggggggcagaggacgcacaaggaccggagcaggtaatagatgcgccatgtgcaagaaagcagggaatcaaataggaaaagatgtgagggcttggaagaatgattctttatgcttccctgaacaaagatgagaaggttaggagcatcaaaggccaagcaacgttgatgaatatgggcaggcagacgagatacatgtccctttatcattttatcctttcaacatccccactctcgccacgtggttggaattggaaccagcacaggttacttggcaataggggatagggaaggagaatccacatctttaattgggtctaattcgggtcccacagagctcagaaactgtaaagggcttccgagcgttgttgagggctagctgtggtcaccaggcccagacaggagagtcatggagtcccgctgggggaagctaagaagaaactcaggggcggggggttggttaagtccaaatgccaccaatacgtgtgatcatctctttttgatcaaactgtaaggcatggcagagagtgggggtggggtccacattcaaagtcctcatcaagttggctttgaaagtaagtctagtgccacactggcctttctgtttatacaacaatttataggtttaaacgaaaccccgcttgaaaaagcagactgaatcttcctattgtgagcacttcagcaaatttaacaaaagaaagagcccaggcgaagaagaagagagaggagagagacagagagaaaggtccagtcctcagactggtgtgctgcaatctggctggttgctatggcgacgtgatggtttgttcacatggcaacataccttaggtccactattaaaatgatgagagtgaactcggttgcattaaggaaagtgtgctgtatgctaaagcgagtctttatctccagagagagctggacagagactggcatccagtacaaatgagggagaaaaggaggaggaggtaaaggttggaggtctggaagagggaagaaccgcagggatgcaatcactatgaaaagaaagaccctcagttctgtgtctcagtcgagggcctgggattcagaaggtagacaatgagttttgtttgacatggaattcatcgttcaaatcagcccatcagactaatgaccccttatttaaaaaacaaaacaaaacatattccagatgaacctgctgtaccttggctgtagaaaacacaacagtgaacaaaactcaacccatgagctgtggctataaccaatagccaagcacgaatgccacttaaataaaatactctaataaccgcgagggtggcaaattacacggcatttatttatcgaacataaaagtccattgacagctacagatccacatcatctcacatttgagctagtggggaagatttcctttggaaatcgggtttcctgtttcctttaacatagtgacaatttttcctcctactgatgtcgaaagggtggtgatatttcagtgggtattattccaacagccctacctatctacctgtgcttggtttctttctgctatttagcaagcactgctgtggcacacatgagacagccagaagtctctgggctctgtcatcccattgaaggctcccagtggtactataaaccatctgtgggatgtctgaggccccgaaatccccacacccctcactcgtttggcccccttcccacctctctatggctgactgtgctttatttgaaaatctctttaccataaagtgaagtgaagccttcacaccggcaaatgtctcttgaattggacacatggcagaagatgagcttgggactgtgatagtttctgacgacagagatcctaccagcacagggctcagttctaaccatgagccactgactcagttccttctttgtgccaatgctgcagatgtctggtgccaacagagggatctgacccccaggagatcctgtcatggcagaaaagggggaaggcacagtgctctaagacctgcagaaggagctgaatactaggacagagagcaaagccaaccacactcataaattgcctcctccactctcatccccacatttctcctgagtcttacgtgatagaacattgctctctaaaattttctagggtcctatgatacgctctggcttcctcaggagtccatgtaagcagtacagggaagcaggatagctcaggaggcgagatcctaaactttgcattagagacctgctgtcactagctagcctggtgacctctctgagccccagttttctgacctgaaaaatggggtcacagcagtacctgacctcctcaggttgttgggagatttaaatgaggtaacagttataaagggacataactcagtccagggcatgtacattttatgaattattattattccctttggacccagccagttgcagcatacagcattgtttccattgcaactttagcaacagacaaaaacgtgactttcagatgataagctcccgaacaacaggtcaacggctattcacctattttggaagggtccagaataggatgcagcttggacatatttattccagaaccttcttctctacatgctgcaggccaccagagagaggcaggcctggcctgcagctcaacttgccttcttctgctagatgtctttccttttgttttatattttgactactgacaaaacaccagctttgtccctctcccccaaagggtaggcgggtgtctcttcctaagcatggtaaattgtatgtagagaaaaagacagagagagagagagagattgagagagaaagagggaaaccttctggtgcctatcaactttccatgacagctgcactcatgttccctcctgaggaccaaaataactacaaagtgtatgaaatcgttaagcacataaaaatcccggaggtagacgctgagaataaaactcgtgatttcccaaccaaaaggcatcaaagcccagccctcacagttcatttgcttccctccgtcgatctgactttgctcagtaagctggcaacagtagccctacacacagctcggagagcagagggaggaaggctgggcccctgacctgcctggtccaccagcctggtctgcataatgaaggcatgggggcgtgggggagcccagaggcagatgaaatcagccagaaagcactgaaaagagagaacgcatttgaatcttcatggcttttttttttttgcagcttatgatatacttttcacacgtttaatggcgaggcagctaggtttaaagaaactttcccatttaaatgtgccataacagaataataaggttatgcaggatgtcttgatgtatggtcccatcaggtagaatggtgatggaaatacgctgtgatattgaatctgaataggacacctagagaagaatgtttagcttcgggtgttgcagtacaaatgcaggaatagcaaacataggaatagcccttatcttgtaggcagaattgctctcggtttccaatcttccccaatagcccttggcttgggaagtgtttttgtagggagcacagcaaacagaaaacactgaactccaaatgtgtggtgagagctatgctgggtgatctaactaggaagcatccaaagacatagaccattataaggtctgtctccacatttgaccattccctatttactgaacgcccactaatgtgtataaaatctcttcaagtgcatttcaaagtgctaagaagtataaaaaagagtttctactttcaaggagtttataatttagttggaaaataaaatggtctagctgacggtcagcaaactgcagcctggataggcccaaactagtctgccacttgttttgtgtaattaagtcctattggaatacagtttcaatgtgttcaaagacacattgtttacatattgtctatggatgctttttccttacaacgttggggatgaagagctgcagcggagaccctgtggcctgtttaaaatatttactctctggccttttaccaaaagagtttgccaagaacaagagttgctctaggttgggaaggagagcgatcatcatggctgggggtggggaatcatgaaaggataatggaaaggatggcctttcaggagggcctggtgggacctggacagacccagcagagttaagaaggcatccttggtaggggaaacagtacaggaaaaggtgcaaaggaaagaggcagcatgactgtttgagggatggcaagaataaccatccagctaggacagcctgttacattccaaagcagttggcaggaaggatggtctgataagtgggaggaaaaccaagaaagtatgggattcctgaagccaagggaaaagtggattttcaagaagtgagggaacaagggaggtaagcagtgtctggtgctatcattcagaagaacaagagtgtggaagataaaggaatcgaaggaaaataaagaaatggaagtaataagtatggaccacttgctagagaagttggaccaagatatgaaagaagagatgcaggttaataatttgagtaaatggcaaagtcgactgcagaatttgccgggttaaaagagactgtacatgtctttgggtaaaagaggaacagcagataggaaggggctgacgatctaggaagctagaaagtcaggaaaagggaggaggagaaggaggatcacttccagcctctaagaccagtgaagactctgagagagcaaacagacattctgggtagagcagtgggtagctaggcaatgttcccagatggtctccttcatctcataaaggatgaaaacaaaagtgatcaacccatctgggcttaagaggattggcaagtgaataaaatatctgtttaggagccagaagggctcttcaagcatcaaagaaaccttccatgggagccatgactgcttactgtgataacacctcctggcagaggcctttaccttgggcccgagtgtatggtagaggccatgggattatctatcacatgagggaaaaggaactagagtagctgacaagagcctttgagctgggcatgtagccaagtgtagccagactggacctagtggaccacatggagaggaatggactcatattcacagttgcaactgagtcagataggaggcttgctgaaattcacctgggatttgtctgtgatattgctggattgttttttttcctaacagtgtcattcttggaggtgaagaggcttggctcatgtttcaatcatcctgagtaaattagcagtggtatgttttctgctgtaggctcattggattgatctttgagtgtggtagacttgactacagttaaccaatacccattctcctctacttctagacacatgaagggctgtactgcccagctcccttgaagtaaggtattcatttttgtgggaagatcatcaagagaggaagtgatatggtagttttcacaaagcaaactaagtaagtaaagtggccctatgagctttctcattacatgatggagaacaagaagagaatgcaatgatgaaagtgggttaagaaagctgtcctggggatttgagaatgggtgtggcaccagccactacttgcaacatgacacacagaaggagaggcctttggtcaagggagtattaggcttcagaaactgtacaaattagtgaggcttcacctgaactctgtgatttcaggtcctctggcaggagttatagaacttctggagaagatatccattaggactggaagggtcaagttagaatttctaggccctgggtgtggagcacagacctgagagaataatcgtgcctcctgaagttctcagcctcggttttgtgacagcccagagtgcttccaattatctcaaggggatcaacatttgctcttttcttgatcacttttattctaaaaatcaagattggacaggcataaaattaaataataaaaaaccttatatttttgtatagcgcttttggaatttacaaatctcttttgtgtatgttagagctcatctgactctttcacaacctctctggctgcgaagtagagaatggatgataggacagaagaaagaacacagggggccctggagtagtccaggcaagaggcaatatggtagctcagtccaggatggtgccatgaggatggggagaggtggatggttaatgtgaggtcagttccctcaaaataattcatttataagtttaactaatatttatggggctctactatggcccaggcatgtggttaggttctgggtgcttagaggtgctctgtattaagattgcctaaaaatggtgtgggcagtgctaagacagatgtgtgggtaaatagctatggcacaataagagaatggctctaatgaatctaagtgccctaggatctggggtgagtctggtgactctgcctggggaatttagagaagctttccacaggggaggtggccagtccaatgacatggatcatatccattcttatttcatatcatatggccatgccttgcttcaaggtaggtgcgaagtagctcttcaaagtgtccagaagtagaggagaatgggtattggtgaatgatagtcatgtctacaacattcaaagatcaatccaacaagcctacaacagaaaacataccactgctaatttatccatgccaattaaaacatgggctaagccttttcacctccaagaatgataccgttaggaaaaaaaaatccagcaatatcaaagcaatatcaaatgagaagtaattttcctagaagggaaaggcagaagggcatgccaattagaaggagcagcatatacagaaatgcatgtgtcccagaattatggagtttggtctaataatacacacacacaaacacacacacacacacacacacacaaacacacacacacacacacacacaggggagagtatactgaggaggtcagctgaggctatatcgtgagagcctcatgtgattacactaagaaggtggcatttgattgccaagtcatggaagtatcatggaggtttgaagcccaggaaagggatggtccttctacagatggagagatagaagctcagaggctgagcggcatgcccatggtctcagggtctgcagtattgacaaaatactttatcatttattcaatgctactttgtatttcctaacacagataaatcataaagaataatatatcatatgcaacggccatttaagaatttggaaatctggaaggcagctaaaggacagaccagaagacactgaaccacatacgaaaagcctaaagtccaataacgggctaatgttcaacagcagtaagttcagaaatccattctgagccgactttccagttctcagtgcaatgcagtgggtgctcatgagttttaaaactgaagttgtaaaggaatgtagttctgacacataccacaaagaggacgaaccttaaaaacacgatcctaagtgaaagaagccagacacaaaggaccacatatcgtatgagtctatttatttgcaatgccaagaataggcaaacctatagagacagaaagtagtctagtggttgccaagggttgaggggggagggaagtatagggtgtaactgataatggggatgtggtttttattttggggtgatgaaaatattctcaacttagattagggtgatggttgcacaaacctgtgaatatactaaacactcttgaatcctatacttcaaatggatgaattttacggtaagtgaataatatctcagaaaagttcttaacaaaacctgaagctatagcccctatttgggtctccagtgtatttatttaaatattgaaactcccaacatcaacataccttggaggcgatgccatcgatttctttgccaaacgcatcaaagtccatattatgacatcttagatagctctccacacatatttgtggttctaaagaataggacataaacattcctggggataagataactctcagtcctgaggaaaccgtatctcaaaaggctctttgaaaggctttgtctaaataacacaaaacagaacatttggcagaaatgaagcccagacaaatggtcatgggtcttaaggatcaaactatttttgtttttatttgctgggagagtagtattctgagaagccttttggcttacttgttcttgagttctgtgtatgctctacattcctcttatgcacgtagaacagggagaagcaatctatggcatgtgagctgattttaactatgctggcttctactgccatgacctaccacaactgcagtaactgctgcccaatattccaagtattccatgagaccaggtatgatgactcattccctaaacccactcctacccttcaaagagtcagtccttaaccaaacaaccctcttctattccctccccaacttccctagaagcagatctgggcctgccatattgaaaacatggatgaccaatggttggatgaaagcacagtcttcaggtcccttctcctatgatgcccacttttaataacatacttccttacaaaggtggcacctggcagatgaatgaaagatgctccaaggataacctaaattggacttcattctgaaaatttgaaagacaatgacaagattcagcaagtatcttgccttatcattcaagaataccaactttatgtcaagaagcttagacccagcaggctggagtgtcatatgttgagttgccctggaatagaatctttgtgattgatgacaactgcaatctcacattcacccatgtgtggtttaactgaattttgtgcaccgtagacagttttgtttctgtcatttgcccccaggggactctgaggaccttgatggtcttgctggcctggaatgcctcaattctccatggatttataaaatcccagagaatgtactgtgcagactcagggtgaacatagacacaagcatttaatttcctttactggtcatcaaccttttcagctcaggatcggggggaacaccagccagaatactgaacctatttgaccattttcctatgctttttaaatttaatttaatttttatttatttttattttttaaaggcagagcaactcagggtcttttaaacaatgaggtcttaaattgttttaaaaagaaaatagtcttggattcttggatccatctgtagtgcgtattataatcaactgatgttaccagatcttcggtggggaacagagaagtggtagaaactggggaggtggtggttgcacagtcatccattttaaaggtcttccttaaatacctattgctgtagataggtaaatctggtcaatatcaggaaatagtattccctgtatttggtcaatgaaacatcactcactgcttgaccagattgcattccacaagacactagtagtagccatcatttttgagagtctaagacgggagttataggtttggtgtggattaactcaatcttcatgacattttaatgaggcacgtttaattcttatccctgttttaaatatggggaattggagattcagagaagccccataacttgcctaagaccacatagctagaagttaacgaagctgcaaggagagctcagactcacctgtatccagagttctctctcagctattctatgatcctgtctcctgatgaaataaacaggcaaaccaaatacgatgtgtggtggacataagaggagacttgtaacagaattaaagataagtgctcagaaggataaaaccagggtgattgctgcaatatctattccttatgaaaatattccatttgcttcctgttgaaacagactaacaagggataggttgaaagcaaatataagtaagcagatacttcatctttctgatctgtgcaaaacccatcccaagtgggcagtgcaaatccatgctgctcttcctttctcctcttcagcgaattagcacatcgaaggacctctctgtcctccttatatttgcaaagctacatgaactcattcttttcctctaggactgttggtcacaggtacattcagttcagactttttaccctcctttccttgctgccttccttctcaaaatcagcctcattggtagtttgcaagcaagtgtctagttaaaacaaaacctttccaaagggaagaagagtaggttttgctctgctgttttgatttctaaatgtaagggtggcgaaccagattcacctctggtgtttcattgtggattccacaattcatcacgctcttggcaagtggtggtgctccacatggtggggagcacgggggagggatctcaaggattttaggcagtgggcggtgttgaggaaatatcttcctaccctttccaccctcttgcttgtgtcgactatattttcgagtttcactcaatgatggagttgtttcttagcgtcttgtgcgcttagccatttaattaaagcaatccatattgaattcatgtccagatgcctcgaccggcggagccagatcctcattggcatgccagctgctccaagaggaacacggccccttgcatactaatcaggagaggaggcagtgattcatcagcccatgatactgctccagcatctacaagcacttatgacatgtaattggtggtgcataagcaagccaggccacattaaaaaccctacagatagtcagagataaaaattaatgacttttgctttgtgtaatcctgcatgcattggtgggaaagcggagaaggggggagttgggattaatgggcaaatctaagtaggcaccaaggaacaaaggccttcccggccttgtttacatatcgaacaataaaaaacacaagtgacaagttatgggaaaggcgagtgtgaattttcggcacgagtgagttgaaagactgcttgcagtttattacagattctaaatttccatattcattattccaaaacaaacgtcctcagtgggctcttctgggactggctagagcagttgttattattcatctttcacaggggctgggttgtcatgattagggctgggctgggctcactcttcatggcatgccccagctactcagggacacaatgcagacctttgacaagcccagaggaatgtgacagggatcaagtagagtcagtatgagcaggcgctccaacagcagaaggagcctcacacttagagcaggatgggggaagagaggagagagttttgagccacctactgctagacaagggaaatagcccaggtggcccaggtagtagctaatgaccaggaaggaaaggaagaaaggaaagtaggagtggcaaataaagtggatttcataattaatctgggcaggttaatgaatatagttattgggatggtatcagtcaggttctggttaatatggatattaaaaaggggattgattacacgtgtggtttagggtagtttcagattgtgttagaggatcatgcaaagtgaaggcaacaattcatgcatgtgctgcaagacagtcttttgcactgagtgccacatggggaatgcaataggggcaaacgtcaggattttgtagtcagaaactgcattggttgtttatttaagggccttctttaagacacagatggcctggctgaactttgaagtgggcttgagcaagaaaaagcttctaggctgatgggtggatgtggatatgttcagctactgtgatcactgaacaagggagaggcaagggcatgttgatgctgagattgaggggaggatgggtcattatcaaatatttatgattgtggtttggtggaggcagggaggtaattaaaagacagatactaagataataggcttaagacatgatgattttcccagtggtctggctttgtcctttctgaaaggaagagtaacatcaaccctatactcattggtggctttcttcctttctctccatgatggccttgttctgatgatccttatgcttctagtgttcttgttggtcatggactagcttagtgatcctcaggggaaaatctgtgggcagctgtgttagtccattctcacactgctatgaaaaaatacccaagactgggtaatttataaaggaaagaggtttaattgactcacagttccacatggctagggaggcctcagaaaacttacaatcatggtggaaggggaagcaaacacacccttcttcacatggtggcaggagagacaagtgcagagtgaagcggggaaagccccgtataaaaccatcagatctcgtgagaactcactatcatgagaacagcatggaggaaccgcccccataatctaatcacctcccatgacgtccctcccatgacatgtgggaattatgggaactacaattcaagatgagatttgggtaggggcacagccaaaccatatcagcagcatttgtagaaagggcatcctgagagtagaaaatgtccaaagagatgattggcaagaatgtgttaactattcctcaatgtgacaagagccatgctttgagttgagacatccctggtcttatgcctagagtcctttgttcttctgttgccacagaacaaaaccatgctatctggtctgtgcagagagtacatccacaattgtgctttcctaagtgtcatgatttacccatgagatgcagttaagaggagtaactcattcgcagtggtgagaatgcctagaattcttggtactttctgtagaagatcatgagctgttgatatagtatactaaaataacacatttgtacgccagttctgctacattcccagggacctggaacttgagtcttatgcagagaatatgtcaacatttaaaaacaatagaggggttggattttaagagatgacatttctcttcaataacttatatctgggggttagaaaaagacgtgccacgagtaaagctttcatctgccgtagtatccttgttctaaaagaggacagctagcatcacacaggaagagttgggaaatcagtggttaaaagtcctataccacacacccaaagaaaaacaaggcagaagaaaaaaagaagatctcttgagattctcttacccatgttcaactccatgccttatgctaagtggcttcagacaacgtggcttttatagagcctgatccaacaaagtaatattgattctctctttttcaaggttccttctcaaggaagggctggctgggacacatttccagtatcctgaaaaagttgactacataataaaaccagatgatgataaaaacgaaatttggggaaaactggagctattaaacaagtaggaagtcattgagaaacagagattacacactgggagaaaaaaatttatataacgaagctctatatctactagagagaaaaagaaaagaacctaacctgtgtttgtgagtgattaaatcatttacatgacagtgtaggggcctgagctgccctttcctcctgcaaggatgtcaggatgcccaacttggccatgtccactagctgcacatgtttctgagcacctggagttacagagggttatacatcttcccagcagcacaggtctctggctgaactaccacccagaggaaaacttactttctttttgcctcttttaatttcctttagcaaataaagtcctctcaagattttcatctagtcaggagaagaaactaaatcctttgctggcatgtaagaatattaactgtatcggatatgggaagaccactggaccagcaaaaacttatgtggacctgggactaattcaaaccacgaacaaaagtgatgaggcaatggcatgaataaatacgtagtgatctctttccatgaagagctcacagagccctcaaggtagtcaatgaacgtactccatgcaacaagagtggtggcaagagtttgtacagtttccaagagagaaactgagacatagtgaagactagtgattttctagaggccaaattagcaacaaacctagaaatctatggttgctctcttgtacttccctctttcctttcttttttccttcatttctttcctctttccttcctttatggcttccctccctccttattccttcccttgctccttccatctctctgtcttcccccttacatttacttactacacagttttaggagacaaagattttagatagatagatacatagacatgtaaatacataaatagttacatagatacatagtagatagacacatacatggatacatagacacatggatagttacatagatagacacatagatggatagacacatagacacacagatacataaatagaaagataaatatatagatacccagacacagatagaaaaatacagttacatagatagacacgtagtagacagacacataaatacatagatatatagacacaagatacatagacacatagatggatagatacatagacacataatagacagaaagatacatacatacatagacacacagaaagatacatagatagacacataaataggtagatacacagatacatagacacatagataaacagacagaaagaaagcaagaaagcaagcaagcaggcaagcaagccagtcagccagcccaggctagtggtgtcttgattataatcttgttgaagagctattcagttgatggtggggtataggatgagttgacaagggacaataacgagggtggatgtgtggggtagtcagaaagcatttggattttctaggggtaacaagggctctatactaggcataaccagcaaaagaactggaaaaggagaaggcagatgtgagatctgcttcaaacagaaacactgagatttggcaacaaatcagatgtgggatgaggtcaaaggaagttttcaccccaagagaccaaaaaaaaaaaaaaaaaaaaaaaaaaggtggtcccttcacaagacagaaggtacacaagaggagcaggttaaggaccacagctgacttccaccttgtatccggcacgctgaacatcctgctgccaatgcaggtggaagtgttgagctggtgcagtctcaggtaagtctagtctgggatgctggtttgagaatgggtgatgcacccactcacgaaggagggagaatgtccaggatgcaatcagacagagaagaggatggggtcaaggacatggcttatgtgctgaaagaggaaggagaaaggggacaggaaggtctgccccaaaggcagcagggccaggagaatggagtcgccacggccagaggaggacagcgttctaggaaagcagagggggccacggagggtcaccagcttcatcgctgcctctctgctgagaataagccacacgggctgagcagggagaagaggctgttgaatttgctgatccgtgggagggccattttcacggaggtaggcaagaggacagactgcagggggttaaggaggaaggggatgtcaagggcatgaaggcagtgagagctgaaaactcattaactgccctaaatgctgaggacaaatagaataataaacttctaggcaagaatgaaatgcacttttgcctccaggagaccacttcagctcttggagctgaaggaagtggggctctgtgccttcccctgctgtcaacttcctgtccgctgcagcccccgaggttggcagaggggccattgttctgcccgctccccaaaggaccgtcagccgagtggccactcgcagtcactcttctttgtgcctggagagattagaaacgaagaacggaagctcaagaggctccaagacagacgctcggggcaagtggaagcgtttcagagtccccaaatttgaacctgtcccctcctcctctcagtcctgtgatcttccattaaattggataaggagatctcttttcctccttttctttctcattcttttttttttttttttttttttttttgcaaaatgaatgctttctgaatctgcttgacgtaagaactttctttgttccaccctaatgttgatggcttgttttgttcttgagtttgcctgctttgcacaaagggggaaaaatgtcctcaaaactaaactgaattcagcagctctattcatggccaaatttaaaacatttaaaggtaaattcaattagcaaatgtagaaccaattattaggtgaccaaacacagttttcaacatccaaaatgtgagtctttttcagaaaaaccaagacatacataaagagtttcattctcctaggctaagaagatacattttagtacgaaaagggtgccaaactgttgaagtgatagctataataatatttaccaagtgttacgtgctaggccctgggtttttcctcagaaaacaaagaaatcaaacaaatgaagacaggtttattttccctatgacttcgatttttccagaaattttacaattctgaattaaacaaacactggagtgaattagaacctaaaagataaaaagtgattttaaagaacccaacaactgagtaaaggacttatcttttaccccgtgtaactttgctgaatatatccagtatttccaggagtaaagtttccgctgcagaatatttttctcctttgatatatttaaggcactgatgtaaccatccacggctttatagttaaagccatcaaaacaaactcagatacaactctgacagctatttctactgttcgttgccaatgaagattcatgatcagggtatcagtcacctttgtttgggctaaatttcatgtacgtaataataacgtccctgaatgtccccaaggtcctgccatttgattctcccaataactagattcaacatcatgagcttttgtgatttgaattgaaaggggctggaagttgacagtgggggaaggcacagagtcccactgccttcagctctgagagcagaaatggtctcctggaagcaaaactgcatttcattcttgcctagaagtttattattctatttgtcctcagcagtttgggcagttaatgagtttttgactctcactgccttcatgccctcaccgtgtcttgaaatgtctaggccacatttctacaaacagcacatcacagattctttttcttctagttcaatgcccagttctgcctctagccattcgcagcagtgcacgtgttctaagttgtgttaacagctggagatggatctttactgctccacacccaggctcccattcgttctggggtgtccacctgtgtgtatctggggcggcaggtgcaggcagtggaaggtggtggagagggagggaactaaccctattattaacctgcgaagcaccagggactgtgcaaaggcactgggtgttaattatctcattgaatcttcttatatttttaacttttattttagtttcaggggtacatgtgcaggtctgttatatgggtaaatgctgtgtcacgggggtttggtgtacagggtaatccatcacccggacaataagcatagcacctgatagttttttggtccttaccctcctcccaccccccaccctcagggaggcccctgtgtctattgttcccttctttgtgtcattgtgtattcaatgtttggctcccatttacaagtgaaaacatgtggtgtttgattttctgttcctgcattagtttgcttaggataatggcctctagctccatccatgttgctgcaaaagacatgatcttgttcatttttatgactgtgtagtagttcatggtgtatacgtgccatattttctttatctagtctaccactgatgggcctctaggttgattccatgtctttgctatgtgaatagttccgcgatgaatatacgtgcacatgtgtctttagggtacaatcattgaagcctcttaacaattctgggttcaaacctttcatccactaaagcagaatctgttctctgccgtctttgcaaccgcatcccctgtactctcaagggtcatcaacccttagccaagtttaaaacaatcacaatttcaaatttccttctcatgatcccgtccctcgcttccccaaacctctaccatttacctataagagcaccctgtcgagccttaatatcaccctcagaaagatttaaggcagacctacaaggttccctggactcctggtctgaccaccacttcttaccaccactacctgccaaagggacctcccaaaagtgaggcataatttacaactttcccctaaaagaccattagactcaatatcatcatatttcaaaatccccatttatttccatttacctgttagtcccaggctttcaatcatccatatgttcccagatgcttatccttcatggctgtgtgctcctaatctgacccaaccttccatccattcctaacctcccaaatccttatcctacgtcctgtgggactcctgttctgtcatcaccaaaactccctctccctgaacctcccctctacacgttctggcgactgttttgccccagtattctctggaggccactgctttctctgaggccccttcagtggtgagctttgttacttccacatcccaaataccatagtgccaggaagtgggtggatgtcttcatcacctcccgttactgcttccaggctactgttctccaaagcctcctttgaggcacatcccatcacactgtgcactgaatcctcctcctcatcgcagccattgatcaccttgcatagcacatctgctgactcatggaatcttttaatgcctgactcaccgtctttgtctccatccctgcttgccattactcttgatgacttcagtatccatagacaatccatcaaatgtgctggcctctctgctgcttgacttgctcacttctcatgaccctttttcctaccctttctaggtccccactgtactggtcacaccctggaccttgtcatcaccagcaacgtcatcacttctaaaatgctcttttagaagcatccctctctttttaaactttctatcttcccagcttactctttctagttttccaatttcaataagtcttcatcttcccttggcgggggggggggtcctcatcccctttttatgcccatcctctgcctcatgttttgcttccgttcttacacagtttagattccagggttcataactaaaactaaaactcgtgcatactctcagcctccttgatcatcaaaaccctaagttgctcaatcaaaaccctaactgatcttgctcatcaaaaccctacgtctgataaactaatttgtttcctaatctgcagatgagcatcagaacgtgctgaagaaaaccgcacagccaggctgcctgacctcactttaaatgtatgaccacaagtgtcacgtggaccctcagccctgcctagcaatccccaccacaccatgctaggcagcccctaaggagtcttgtcacccactgtctcccctgtctccagcccaccacacacactactgacagttttatccctttgaaacatgactgtgttctcagagcttccccaaccgggaggctgggcacatcgtagggccttggcaaatatttgatatgtaagtaattaaatgaatcacactaaataaaggtcaactttttttttcattttaacagtcaaaatcctctgcagcttggttcagccacatctcctatatggggcctcttaaccccttcaaattagtctatcagttctatcaggtctacaaacagactacagtatcccgaaatatgatcgattcgatggaatcatgcaaacttgccaatatatgactgctctgacctacaaaacagcaatttcacatgcacccccacccctgccaatatatgtttctgcctctctgattttgcttaagccattttaaatgccagattatctttctgggtgatatagtttggatgtgtgtccctgctcaaatctcatgctgaaatgtaatccccagtgttataggaggggcctggtggagatgagtgactcatggggcggatttctcatgaatggtttagcaccatccgcttggtgctgtcctcgccatagtggatgagttcttgcaagatctgatcgtttaaaaaatgtgtggcacctacccccttgctctcttcctcctgccttcgccacgtgatgtgtctgtttcccttggccttccaccatcattgtaaacttccagaagcctcctcagaagcagatcccagtgctatgcttcatgtacagcctgcagaactgtgagccaattaaacttcttttcttttaaactacccagtctcaggtatttctttatagcaatgtgagaatggaccaatacacttcaggccatccaacttgggcttcagaatctgattttaagtctcatctcttccaaagaggctctgaatgtagagcttttctcctgccctcccaaagcactgtgcaactttttcttcttcacctgctctcctctgccttgtaatgaagttgtttgtgcctatctctcttctctcattatctcctccagttgtgagtgaactccttgaagacaccatcttgtcttattcatctttgagtccctcacaggttctattacgaagctctacacagaggagctgctcaacaggtatttgttaaatgaactcaaatagtggttaattgttccaagcatgtaaccttatattctatcatctaacagtgggagaaataggtgtataaagtctatttcgtctttttgttccacaacaattttaaagtactaatatatttttctattagacgttttgccacctcaccaatagtaggagagaaaattcactgggctgggagcgggttgcttattcaaccattgagataagccaactaatcaaccatgaagagtaggaggcctatggtaatatttatcctggcaggatgttctcctggtcatttccagacatgaactgacatacaagggcttaggactttggatattccacaaataaagcatttctttggggcatcagcggctccttcatttggtctaaacaataggtgaaagaaaggtagcagctgatgcttcagctgctgacgatgatgacaaaaacgataatggcatttatatgattcagcagtgctcgacaaacccagcaaattacttgtaaagttggcagtcagggctgtcaatgagagagtcacctttgggccagaaagcagcagccacatttgcataaaaagagagagctcctagcacctgacagctcagagggaggtgagcaagtagaactctgggatcagggagactcacggaggtaacaggcttacgttgcagtagggaagactgatgctcagaaacaaggaagaacttccggagaactagggtcttagcagaggaagaggtgctcagaggaggttattgaacttgctcataagagttaaagcagcatggtgttggtgcctgaataaacagaccactggaatagagcagacagtctgggaatacagccaagtgtatatgaaaatttaggacataataaaggtggcactggcagtcactggggtgcagatgatcttatttatttatttacttattcagaaacaggtcttgctctgtcacccaggctggagtgcagtggcacgatgatcatggctcaccgcagccttgctgggctcaagcaatcctcccacctcagcctcctgagtagctgggattataggtgcatgccatcacgtccagctactttggtttttttgtgtgtgtgttttttgattttgtagagacgaagtctcaccatgttgcctaggctggccttgaactcctgggcacaagtaacactctcacttcggcctcctaaagtgctgggattataggcgtgagccaccgtgcctggctgatctttttacttggtggtgctaggacgactggctagacagttttttgatatagttagtaaagttagttctatccctccaaccacaaaaaagactgtcttccaaagtggatcaaagagctacatgaataaatgaaccctacaagtactggaaaaaaacatgggtgaattcttgggtgtgaagaaatgacttctaacttgagtcaatatccacagtcaatagaagattgataaatttgattatataacatttaaaaaattgcatgaaaaaaacatcataagcaaaatcaaaagatgcgtgacaaacaggagaaaactgtttgcaatttgtatcaccggccaaaggctaatttctgaaatatacaaagtcttcttaaaaattgagggagccggatgcggtggctcacacttgtaatcccagcactttgggaggccgaggtgggtggatcatgaggtcaggagttcaagactagcctggccaacatggtaaaacccagtctctactaaaaatacaaaaattagccgggtgtgatggcaggcacctgtaatcccagctactgaggaggctgaggcaggagaattgtttgagcctgggaggcagaggttgcagtgagctgaggtcgcaacactgtactccagcctgcgtgacagagcaagactccatctcaaaataataataataacaatagagaggaaaaggccaataaaaaatggatgaaggatgtgaacagatgattccaaaaaagatacataagtagcctttaaacataagaaaaaaatgttcaacttcatacataataagtgaaatgccagtgaaactacattaaaacagtttgatggttcctcaaacgattactcacagagttgccatatgacccagaaattctactcctagatgtacacacccaggagaaatgaaaacatctgtccacacacaacatatatgaatgcttggaattgcattattcgtaatagactaatggtggaaacaacttaaatagataacagataaatggataaattccacagataaatggataaacaagagatggtatatatacacaatggaatactattgggtcataaaaaggaatggagtactgatatataccataatctagataaggcttaaaaatataatgctcaagtaaagaagcaagtcacaaaaggctacatattgtataagtccatttatacaaagtgtcttaaatagccaaatctatagacagaaaatggatttatggttgcctcgggctgggggttatgggacattaggagagtgagaggtaaatagtactaggtttctaaaatcggctgtggtgatggttgcagatatatgtgaatatactataattcactcaattgtgcactgtaaaatgggtgaattgtatggtacatgaattatatctacataaagtggtttttgaaaaactaccttgaaatattatttctcacctattagactcataaatattagaaagcttgatacattctgctggtgaggctagggggaaacaggccttttcataacttgttagagggaatgcaaatcggtacaatagttaaggatggggtctttgcaaaagctaacaaaactacgtatttgtacacctagtgacccaggaatgtcacgtttaggaattcacctaggtaatttatcctgaagacacctgtccaacaatataatacatattcacatggctacatactgaagcatggttcacaatggagatattggaaacaatctcaatggccacgaatagaagactggttggataaacgatggtgcaatcagacagtgcggtactattcggctggagaagaatgaggaagagctccaggagtcgatgaggaatgatttccaggatgtgttgagggaagaaaacgggtgcaaaagatcatttctagtattctctattttttataagaaagaagaggaaataaactatacaagtatctacctattttaacaaaaggaaacattgggaagaaaatcagaaatggaagagattggtttcctgcaagaggtgggtaggtacaggtgggagggctaggaaggaaagtggcacttctctgaatttgcctttttacttaattttgacttttatgatcatgctaatgttttatatatgcaaaaaatccacagggatggggagaacacccctaatagaaacaaatgaaccaaaaagtatttcaaatgagcaacacagtgacactgtgtgggggctggggaactggcccaagtgaccttccaacagagagttctgaccaggtaccctcagtctaaatactaaacaaaatattgaagtctagttagcaggtatgtttttcacagtgctatgcatgaacaattccaaaacaacttcctatgtatctcaggattgaacaaatgaatgaatatattgagaaacatgagagctaggtatctagtttcttttagtgaagacatgtttttttctttttcttttttttcccctaaatatacaggaaggggaaagctaaaatgttgtaggactgaaatggaaagtatcagtatgtttcatatatatgtgtgtgtgtatgtatgcatatatacattctgtccattaaaagagtcttgaattaatgatatcccagtagccctgatgctcagatctttcaaattctcttcttcaccaaaagaatccaggactctttggagagatggctgaattccagctcaggtaagttatagctgatcctgaacatcttgctccataaaacaagaaagtgctcaaagcatgaagaggaggccacatgcggtggctcacacctgtaatctcagctctttgggaggccgaggtgggaggaatgcttgatcccaggagtttgagaccagtctgggcaacatggcaagaccccatctctctaaaacatttaagaagttagctgggcatgatggtgcctatctgtaatcttggctactcaggaagctgaagtgggaagaatgcttgagcccaggagttaacgtgagccatgataatgccactgcactccagcctgggcaacagagtgagatcccatctctaaagcaacaacaacaagacatgtgaaaagaacagaaagggctcctgttgtccaactctgggacaatttgggtatcaaaataaatcatgatggtaatggattacaatcccttgaataatccatcagaatccatgaattcctactaatataaatggatgcataaatatatcattaatggagagaagggaaagttctttcttgcagtagaatttgactcataaatgtgaaatgatggaattagaaaatcactgggcaaacatcacagtaataactggttcaaataagaagtgcccatggatgctaaaactagtaggtgaatgtttgatgaagatcaggatatttatgtcacttcaaaatatctctccacaatttcttattagttgcaaatggaaaaatagcaaccttataatggagaaacctggcacatagcacctcagccaagtcattaaagataacatcacaaataatggcactgacccaaaatcatatcctctgacttcctcactgaggaagacacagcatcacttctggggtgtttctgccaaaaattcatcacctagatctaatcataaggaaacatcagacaaacccaaattgagtaaccttctacaaaataaatggtctgtactcttcaaaaatgtcaaggttaaagaaagcaaaagaatgggtgaagataaagaatgaggaattgttctggtttgaaagaaactagagagatgtgacaacgaaaggcaatatgtgtttccggataaagcacattcttggaaggatggaaaaaatttgaatttggactgtggattcattgatggtattgtataaatgttcaattttctgatttagataattgtactgtgattaggtaaaacaatgttcttgttcttaggaaacatacaccaacatgtttagggataaggaagcacaaagccagcaatttattctcaaatgactgagaaaaattatatatctacagagagagacagagagagagagagagacagacagactgacagggagacagggacatggggaagaggagaaaaggcatgaatggtaagggaatgggacaaaatgtaaactgctggggaagctcgatgaagagtatgtcagtaatttttctactagctgctttttgtaactttgacaataaaaatgaaaagtcaagaaagcattgctcacagatctttgagagtgggcaactgctacatctcagttttgacacctgcttgtgaatctggggagctgcagagagaacctgggtcccttgggcctttgtttttcaagctgcaccaacttgccctgtatcccttgtcctgttcatggaacttctcagccttactcagcttaaaggggttgaatgtgaatggtttggagcaaaatcttttcctagttaaaagcattttttttcatagccctggatttaaatctttttatacggaaatattatccaattagacacagctattttcttttattttcagacaataaaaagtcttattttgttatttctttttaaaattaatttgagtttttaagttccagggaacatgtgcaggatgtgcaggtttgttacataggtaaacgtgtgtcatggtggtttggggcacctaccaacccatcacctaggtattaagcccagcatgcatcagttatttttcctgatgctctccctccccccaccccaccccccgacaggccccagtatgtgttgttcccctccctgcgtacatgtgttctcactcttcagctcctacttataagttagaacatgcagtgtttctttttctgttcctgcgttagtttgctgaggataatggcttccagctccatccatgtccctgcgaggacatgatctcgttcctttttatggctgcatcatattccatggtgtatatgtaccacattttctttatccgctttatcactgatgggcatttgggttgattccatgtcttggatattgtgagtagtgctgcaatgaacatacagttgcatgtatctctgtaacagaatgacttatattcctttgggtatatacacccagtaatgggatggctgagacccagctattttcaatatgacgttgatctgtgagtgagaagtcctcttctcacctgtggtgcttggtggtgctcggtgacaccagcccagggccctgcttccctagggcacagatgggtccctgactcagctgtggccagaatttagaacatgttggttctgggttgtgaaactaagccataaagacgctgggattctctaccttctgggctatgtattattccttggggagggctcccaggccagaatgagggagctgtccctctgagacccttctcatccttgggttatttcccccaaggctcagcgaccctgcaccttttgatcagcccctctcctggctgtgagtgttgagagacccccagtcaaatcgtccccaactcaatatcacattcagatgcccagacaaagtgtgatgatccaatggatacatcctctgcctgccttttggaacttttccagcatttgggaaacatctgtccctcccagaccactgaaagcttgtctttgaaagcctcacgcacctggaacactctgggctctcccaccgtctgtcctctcgccaccatggatgcacagggccccctttgtctgggcaggcagcatctccccactcagcccagccctgtgatacccaaggtgaagaagaatcacagattggccaaaacagctatggaatgggtcaccccaagttgtcatgcactttatttacttatacaaagttttgctttgtcatccaggctggagtgcagaggtgcgatctcggctcactgcaacctccacctccccggttcaagcgattcttatgcctcagccactggagtagctgggactacaggtgtatgccactatgcctggctaatttttgtattttttgtagagatggggtttcatcatgttggccaagctggtctcaaactcctaacctcaactgatctgcccacctcggcctcccaaagtgctgggattacaggcgtgagccactgtgcccagtctgtcatgctctttggacactgagaatggggaccacagacctagccaaagagacctgtgacctaaagaggccaaggaagaggagacttctctcctccctaaaccatgaagttaactatttaccactgttgtaattatccttattatttcacttaagaatgataatgatgattccaattaatcttcatgttcactataaggaggtatggtcattcctgtgttacaaggggaggaaattgaagctcagagccataaaataaccagcaaggatcctggaactgctaggtgcctgaacccagattcaaatctaggtctctgtgatgccagagccatatagaagacacacaaataaatatttgctccttcaaatgactgcaaagtctatgtttacacagttaagtccccaattcatgtcatcccaaacaaacttcttccatctgattctacttcctgacacagcagggcccacaatcacaaccattccttttactgggagtatcctcagcccggagggaattgctaccttttcttagctccattgctgtctgctctccaggcctggatgccccgtaacaggtattcctgcagcccacaatggtgtccagctttgttgggatacccagtcgtggaaacacactttgtgatatcagcatctgttccatctggggcatcagggactcagcctgttcctcacccataacctccttgcccagtgggtgtctctgcaccgtcctcacccttctcagaggtagatagcagcaaccaggagcagggaggctcagtgagagagaaagtcattggtattggcaggtggctgaggcttgacttggagctatcagctgtgtttaagcatgactgctatggtaacacatttgcgctgagaactacactctctatttgtctgttacagtagttaatttcatctgttttgcagaaatatttactaagggtgagtgatggaggcaggcagctgtggctgcatccactgtaaccatatggtttatttacaaccagagctccatggtgcagatagctcaaagaggattaaattatactttgtagattaaagtcctgaacactataaaactcataagcctttgtatgctaagcaagaactttgattcccattggacatgaagctgatattttgcacacacagaaagagtgaaaacttttgatatttaagtattttcttaaaaagctggcagaatatcaagcttgttccttaggcagttgactggttaaaggggaaaaaagcagcttcacaaataccttttaaaggaactgtgtgacctgcttcattctcactataaacaaggcctctccatctctgtttactaatcttcttgaacttgggcaggccgactgcttaaaaggaaactgcctccaaccagccaaagccacggtttatttttctgctggccaccaagacatactccatgtaattacatccgaagcactcggcttctccaagtttacttaacattggtgagaaaataagtcctaaggaaaagcctagcattgttggaatcttccatgcaactgggagcagctccgttaagtctccctgcgatgggttgttaatcacctctctggcaagggtccttcacctttggggtgggtcatttgtcctcctcccagccccccaaccccagcctccatcctcttcagaccctgaaagaattccgttcaatatagccttctcattcatctttaaagtttcactctctgtcaccttccacttgaagccgtgtttgatgtttccacgggcgtttctactgatgggcttcacccggagagctttgtcgttgactttgagactctggcgttcagaggatggactgatcttcgcaggtgttattttctgcacacggtgcaattagccacacaagcccaattggcacaagcaacacactcacacgttctttgcactgaacccttggtgctcatttgggaggctcttgtgggacccacattcccggttaaagacgggaaagttccttgtggatgaccaaccctcaccaagataggtgtagaggcaaattcagcctgccagaagcccagggacttctcattcattggaggcaagtcttatgtgcctatgtagggaatcagataccgtcttgtggcatttcagtaccttggttcggtggaaaatcaatgacttcattaaaacacagtgggaaaatatacttttaaaagaatttggagcaagaatggggatggttttattatcctgggggtccacaggaacttgtgtgtctcagccttcttttgggggcatcaattaataacagatcaaaacagaacagattcccaaggagtatttttcacactttcccactcagggatctcccgagggatctcttgtgtcttcctgctacctctagacttttgttctgccacagcaaaggtatcaaacatcttaaaatctggaaaggaggccgggcaaaggcttggaaggcaacaatccccgggaattcccccagctgcttgtcacacaccatcctcacacccttcccctggagtcacactgcaaccctgacacctagttggagattgatcacctgatcagaagaattacctctaaccaagtgcacagtcagcagcctcatgcaggatttgtgagatcccatacagtgtttagtgtgctctcgtaggaggtgttagtagcagttgtgtgaataaaaggtgattgtaactgtacctttcattggggtgatcttgtttaattttcacaatcatttcaagagataaggagtacagatgttatcagtttttgtaagtgaggaagcttgggtagagagcttgtctatcgctttacctctctctctcccttacttcctccctcccttcctccctccctccctccctccctctctccctccttccctctctccctccttccctctctccctctcccttccttccctccctccctccctccttccctctctccctctcccttccttccctccctccctccctccttcctccctcttttttccctctcttccttccttgttccctcttccctccctccctccttccctccctttctcccttccttccttcttccctccctctcttcctttcttccccctcctctcttctttactccccttcttcttccctcccttcccctcctttttcctttcctctccttttcccccctttccatggatccttgagaactcaggcctgatacccatggcttttgcctttccagttctttattctggaataaagaactggcaaggcagaagcctttttccttgtgtagggaaagtcacctttctccacacagagaaatctgccttcttttaagcaaaacagtttgagggaggatgctgagtcttcatcagcctagattccaattataatggacctatagcaagctgcactgaaatcacatctgatttattcaaccccttttccctgatgattaccttctccattctgaacaagaatatctcctctttctgggtgagggagcagcctgatgatagcctcattagaaaatgcggccgctccttcttgcagtctaattggctgacagggtttgggatgtgaaatgtaaattgctgacagtgtgcacggccctacttttatcacagtgaaatcttcagctgtcaaagcaaatggatatgtggagtggttcattttatgtgtcattaaaagacccataattccggccatacgtctttcctggattctttcaagaggtggtacttgggattccctggactcctgagtgtctcctggacaccctacacaacttcaggcatggtgaaggcagctgttgcagcttcaggtagcgaagactcaactgagagagttggccctatgtgggatttctcgggcttctcatataggcttatgtttcactcatcacttctcctgcatcctgacccttcggtcaagtgctggaatgttccagaagatgagatggttggctgctgtttatggtcctggtggctagaggcattgctactcaagggacactggctggtgagcagctttgagagtctgcaagccaaagacggtctcttgggagaaatctctttgtagggaagcagcatgtgcgcaaggaagtctgggcaatcccagagcctgagttctgcttcctggaaagtgtatcacaagctcctcaagggaggatgtgggccagctcatcgggatccaaacccatgcaccggtccaaccagtgacttgaaaaatggaggtgtcagcatccgatgaccttccccgcataagaaagggaagtgacactggtggcatttggcgttaactgtccaagaatacgtaaggatggcaagttaaacagtaatcaccaggtaaccatctcagacagatagaaacagaggggaaaaaacccaagagtagctatctttaaagagaacaagcagatctgagtaatccaatttaggagagataagagcctgctgctagtactgtcctttaactggacaaacgccttcgttcaagtgtcaaccccaatccgggagaggtcaccgcactgggcctgctgcctaatatactcctgaattggctgagtggctttccgaacaaacacactggtccaacagaattgattttcaacaggccgtattggtccctaacgtaattatccagcagtgagtcagttcacggcggcccctgcatttaaacgctgctggtcagcctgggagaggggacagctgtgcagaggggccttctccaaacttcacttgggaacctgtttctttccccccagctgcttttctcccagcttcctaaataatttaaagagcgatggggattttgcacagctccgtcttaagtgggcattgtcttagaggccttggtctcatgtgccaatgaatatcaagtcctggctgtttgataggtgaattcaatttaagataaggaatcaaatggaatccttttaaaacgcttcaatgtttaacctcttcctttcttcaaagccttcttggcagcacggtttccattacctctgggtctccagccttccaggggggcaggtccatgggggtgacctcccagaatagtgccctcccccaaaagactgtcactcaaagcctctggtccaggtccttgtctgtcaaatgtagtatgacctttaaactttcagctgaacattacaaaagtatctaaatgtcaatgggttcccaaagctggtagatccattataaagggtatgagaacttttataccatttctaggatatccaaataaaataacttctccctggatgcaggaatagtggcaagcctcaaagaccacaatgttccttcccattcatcacttccattcagactgagagaaacttacatatttctttcagtctggggaatcgccatactggtactatcttttatacacagccttttagctcatgcctctcacccgcagagagggcaggagtgaggtctgaggcatccttgtcctcctgacacccagtgcactgcatggcctaaagcagtactcagcaacgctgtgtggagttgaattaaagtgatttttaatgacaaaaggacaatcaaatagctcggtaagcatgggcaatagcttgacctctctgtgcctggactgcatttcttcatctttgaaatgaggataacggctcctgtggcatgaggttgttataaggataaacggtgtcactatttgtcaagcctttggtttctctctctctctctctctttttttttttttttttttttttttttggagacagagtctgtcacccaggctggagggcaccaggcaagatcacgactcactgcaatctctgcctcccgggttcaggcaatcctcccatcccagtctctcgagcagctgggactacaggcatgtgccaccacgccaggttgatttaaaaaagttttttggggtagtgatgcggtcttgctatgttgcccaggcttcaatactcatcaagctgttggaactgcacctgggacacatagaagctttaagtaagggacacaactagccacttacagggtagtacaaggggtgtccaatagaaacagccttcctgaagcttttcttcatatgggacttcatctgctgtgaaatcctcagctgcactggtcaatcagccgtgctatccagcctggcctccctaaactggcttggttcagggctggggtcccaagcctgtgtgtgtgcctgaccagaagcctcatggtccaggggtagagagttgctgatgaggagatgtggagcaggacacgaagagatgtgtctctgcctgccccgccctagttccagggggaatccacacaggcagtgacaatgaatgaattcatggtggcagtgaccatgagagaaattgatcatctaagttctcaagaaacactgtgcattcatgattgacctgctgggaggctctgctcaggcaaatggtaagacacagttagaacccgtctgcaagagacaagaaaaatattcccatttgtttaaaaacactaaaatcacccatgggctcatttcgccaaagctgttttggttttcaccgagtccccctggccagagtggagctatgaaaaccaaagcaaggactgccatccatttactcactctgggttgacccaggatcctgcttggctcaagcgacctgactgaaatgagcacacactggatcatttctgaagcccaaactaacacaatagtgttattagcaataagattgataatgtgctggatactatttaagtgctcttcttctatcagttcacttaatctgacaggtaacatcactgtcatttcatctgaggaaacgaaggcacagagaggttaaagagcatggctgagatcacagatttgggactttgaaccagctcatggccacttagccatcctgcccctctgcagagaggaaagtagatggagatgctgcagtttacaaaatcacgtgaatgctgttagtatagacccagtgtgcggtgaaaaatgaaaggaagcaggagaaaaagaggcaggaggagaaaggaagaaagacatttggcataaagaacaggaggagataggaaaaagataaatacgttattaatacttaatattgttatttttatttatcaaataaatagtgttcatgataacgacaggtaacatttatggagagcataaaatacgccatgcgctgcattgtatgaagcacttcacattcagttatttaatattcataatgaagcaatcagttattactacaaatctcactcggagagaaggaaactgaggctcagagaggttataacttagtcagtatgggaccaaaatctaaccagagtagggctgtgggatttagcaaataaaaatacaggacacccagttcaatctgaattccaaagaaaccccagatcatctggcacgcacttacactaaaactaaaaatcatttaggacatccttatgctaaaaaaaatgtatccatttatctgaaattcaaactgaactggcatcttatatttcatctggcatccctagacagaggcattatgaggttgtctcaagtttttatagttttaagctggcaggaacttgaaatgtaaggtcccgagtgtattcatctgatcagattctcagtgcatctgtatagacgccaacaggatccaaattcttaactggctgcaaatccaaagttttaagtgcccgagtagaatctcaggcatgtacgatgactgcccagctctgtgctggggggcatgcccatatggggccctcatttcacgaggtctcccttccacgccctgttacctgcaggtaacatgcctgttaccagcatggcctctggaccacgtgcatttgacctcctccccagtccagcgtctgcctgcgtgcaagctctttctgccccaaacaggaggccaagaattttcccgctttcagtgtgcacagctgcctggcagccagagacagcgacctcatccacccttcttcctgcctgtccttcccctaaagtcctcctgaatagggtcaggttctggctgcgtttttcagtctctaattagcagattccaattcatcaccctgagtatctcccggcatcagccccaagattccctcctcttgcctggtgaatcggtcttcatttaaaaccctctctcttagccctaaatggaaatcaattctgcaagtttagcaaatagttaattactccacaaagaggattgattggcctttgatcaccagaaagctctgcagtgctattagtctctttcatctgtgattaaaccacagagagaaagaaacaaaaactaaattaggcttctcctgttatcctacaaatatttaatgacgggctaatctcctagaggtgtgttcgggggatacgtgttccattaggagccagcttccattcaaccttgaaccgagattccatctttgtggagagtgcagcaaagaactttacagaggaacagagctgggctcaaagaaacgctttgtaggacacactcttttctgccttttcttctcttctcttcttatgtatgttttaatgcagataaagattttcccagtggactcctgacatgaataataataataagaggaaacctggcttaaaaaattccatttgggtttttttctaactctgtaactagaaccagatcctgtccccttgatttgcacacaccaaggagttcctctctcaagccacagactccttcaactaggggcagaaaaggcaggtgccatggagctttttggtggctacctcttcctgaatagggacactaaagagcagggcaggagctgggatggtctgcttcatccaatcctcaacatcgtcatgtacaggaaatgactctttagaaaaggcactttctgtgatacaagagtcctataaaggacataaggaaactgaggcacagcagggaggacagatcaaggaccttggagtcaggcagaattgaattcaactgctccctctgcttaatatctgcgtgaccttgggcaagtcgcttcacatctcagactatgtacaaaggtgaccataacgcctactttccagggctgtgctgctgatctgttccaacagagcgcgacggtaccaagcatagggcttgacgcatagtaggagcatttgttgctaggtttgctcccctccctttcttttactcagggtcacacagctcattactgagagagttgagcctggagccattgtccttcccgagtccagggtttttcctcccccacattcacgctgcctctccagcaacctttccactgtacactttccattctgcttagaattcatcccagagacctaagtttccgaaataacatcaaggcttcagaattaaagaagagatccaggccaagaataatacagccaagaaaccaaccaggttttcgttgaatgggcactttctgaatggcggagtcaccccccgccgaccattgccaacccactggataagctacttcggtctccagaaacaaacacaagacaggacctaattgattgcttttcagcctggtacggctggcccgatgaagacagctggcatgcactttgtaacaccctcatttgttcttcctgcagtctcatgtacagccccacgggtcactctggggttttcctcttcataattttatcagaaaaaccctgctaattggattgacctagagcaagacggtgatgttggcaaagtcggtgctctgtaataccagttccagctttgtcttcaacttgtccccacgctgagacgggacccctcacggcggtgacacatgccttgttctacatgctaaagaccaatggactctgcaccagatcatccagtgggagtcccagctccgacacttacaagctgagcgaccttggacaatacaatggcaatgctaacaagtttaattaacatatgctgagcaccttcttgtgtcaaggacggagccagcatttccatggggattaagtagactaattacctgaaagtatttgtggctatcaatattatcattagattttgttcggtttcactcacgtcctttcaacattcatcctatacatgaaggctgtttgctgcaaacacctatgatgctcacctgagggcttttttttttttttcttcctggccatgggagtacactaggcctgtgctgggaggtgcccaagagctaacagggtgggaagcagccgttaaccagagactgactgggatttcctcctccctcgggtggacaactctgagtgtgtgccccataccacctcccaaagttacccagcagagctcagctccaattggccatggtggaaatgtgctagataatacacattttatggacttctttccttcccctctttccctttccccactcctctactagtgtttcaccttccaaatagatgatttctcaaatttttgtctctggttctatttctgggaaaacccagactaagagaatagatcttaataataataataataccccccaccacaaaaccccagcaagaatatttgttactcgactgaaaatttggggcataaaatgcatcagcaggtttgcatcttggaagaaggttaaaatgaaattaattacaaaaaataacaaaaattgagagagagagagaaaacaggaatatggagaagcaatggtaacgtcttctgggagcaaacaaacggtgacagaagtaacctagggcaactgagatggcaactaagaagagtacagggaaggccagagccttctagaattgagagagaggacagagacagagacagaaagaccctgttggaggcacactgggccctgttacagatgagctacttcaatgtcactgtggttttgccagaaaaccagagggcttaccctataggccccattcctccaggttctaaaaggagcctaaaatgacaggttccccttggaccagcagacagaggagtggtagggttcaggctgtacctggcaggaatttttagggcgtgagaatttgaaccgtggcctgtgtcgggaggtgtgtagtttgagtggattcctcttccgggtcactctgtcagactcctcacattccttcggctccatctggaattgcccatttccctcttccaggctggtctgctccaacccactttccatgcccacccactgctgtctaatatccttcagggacttcgcactgctctcaggagaaggaaaggtaccctgggcccacccagcaacgtctggatctctccctgtgagcctcccccatcccctctcgggagcatcttgctgctccgtgaatcagccctgctccttccagggcctcccaccatttcctccctctgcctggcttcccaggcctgggcatggagctgggctaactcttctgtatctgtcaagtgtcagcttaggagcttctttgagacgccttgctttgtacggatttgtgctaggcagctccggaaatggcccccagcaccgtccactccctggcatctgcactctcttgcagtcccctcccctcgagtgtgggctggacttagtgaaccacttctaatggatagaatatggcaaaagtgaaggcgtgtcgcctgcaggattaggtcacaaaggacagcggcctccatgctctctcctccatcacttgctctgatgtgagctgcactgtgaagtggctactggcgggaaaccgagcgcagcctctggccaagaacccatgagaagctgaatcttgcaaatgacccggcgagtgagttcagaagcagatccttccccattcaaaccttgagatgatggcggccctggctgacaccaaatgtaaccttgtgaggaacccaagctaagctgtgcccagattcctgccctgtagaagctaagatggtacattgtttcaagccactaggtcttagggtaacttgttaggcagcaacagataactaatgcagatgacctctcatccatatatgcagacagggtacgctttaggggacaattttgcaacagatatggactgtaaaacaactctgtgtccagctatgggaggcacaatggcctagtggccaagagcagggcctctgaagtcagaccaccaggatctgaattctggctctattccttgccagtcagaggaccctgtgtccattatgtgacctctgggattcagttcttcatctacaaaacagaggtaataataagagtcaccttataaagtggatgcaaagattaaacaagataacacttgaaagttgtttcaaacagtacctggtccataataagtatttaataaatgctgcctattatcattcttatgaggatgataagagagggtataatataatttttggaaattgagcatcttgctttctgcctagggagacgccacagctcataaaggaagatcatacaaggtaatagacaattaggtgctacatcatgttctttaggttctaaaagaaggagtttagaagaggttttttttttttttttttaaacaaaaagggatagactcccctggaatgtttcacagtgaagatttacctaggcaagaaagattattagactcgaagtgggcacaaaaggaaggagtagagaatggcatgtgcagagaagcagaggtagggacacaggggtgaataagagggcaagaggcttggctggagtggaaggtgagtactgggggaaaatgacatcaattagggtagaaatttacacaccatcggcaaaggctcagtctcaatgctgtaggattggggaactctgtggctaactcagtatttgcgaaaagtgctgcaaacaggagagtttagaggcggaagaacctgaaggctgagaggtgccatgttcttaggactggagaccagaggctggctggctgtgtctgtgagcccagaggcattgggaaggaaaggccccatgtggggatggagaggccagccctgccggaccagctgtggcatggaacgtctggagctatcttctctctggaagtgggtgagtctgagaatagctcccattacccacaagtcactgaagccccgaggcatgagtgtttgcaagttggtgcatgtttaaggtcaagggaacattgatttccgccctgagttgtgggagaagccgctaatttgataagacagaacattaaagattcagtgtggatgggtattgatcatggggggtggttcatgttagatgggattttttttttaaatgatcaaataactatgggtagaaaactaagtaagaattacccacctgaacctaccttgtttgaggtgctgtaaacctgagtaagacataatgcagtgattgagtgcacagctttgaaggcagagagatgtgggtttgaatcctgagttatcacttattagttgggtggcattagatacgttagccaaattctctgtgcctcaggttccttacagggacaataagacagttaatatctacagcaagaagtcattgtgagaattaaacagcaagatacacgtgacaataatagtataataataattgcaacaacacaaccgtgagttgcgtatagactaatttaattatcacaaccacccaatgaggaaacttgccaaagcttacacagcataaagccgagatttgttttgtttcgttttgtttctttttgttttgttgtgagacgaaggcttactctgttgcccaggctggagtgcagtggtgcaatctgggctcaccacagcctccgcctctagggttcaactgattctcctgcctcagccttccgagtagctgggattacaggtgcccaccgctatgcccagctaatttttgtatttttagtagagacagggtttcgccatgttggccaggctgatcttgaactgctggcctcaagtgatccacccaccttggcctaccaaagtgctgggattacaggcatgagccaccatgcccagccgtataaagccaggatttgaagctgggtactctgtgttcagagctggcactgttaactctggagaacacagttttaacataagactgcagtgtctggtatatgacactaaatagctacttaataattgacagcatatatgttgataggagacctagaagttcatgctgtctcttacattaagtctttgcaagctgctgaaatcatagttgtgattctggagggcctcactgttttttctaatggaaccgtgcagggatccatgcaaaaaaaagcaatggggggtcatgagccaccccagcctccacactggatgatggagacaagaaaaggaaaagaaagataatgaaaaagcaaaaacacacacataaaagcaaataaggaaatgggggcacttttggcattttgagtttgaggatctaggaaagctcatcaaagcctggaaagtgtcagcaaatgccacattgcatgcctaagtcccattcccaagagcatcaagtggtctggaataactaaaggactccggtaggctggcacgttggtggcctccagtgaatcacacttcttgggattcgtgcccttgtttgcctcctcccataccaactctgaccttggctgtgtgacttgctttggccgatgagacggtggcaagctcaaagcaagaagaggcttgataggtgcttgcacttggggcttgcccccttggaagccagccaccatcctgcaaagatgctttggcttgagcgatgagagagaaaacgtggagagggaccacagagctctggcctagctcacagctgaatcgcccagctgaaatcatgcggaataccactgttgtggttttaagtcactaaatcttgaggtgtctggttatgcagaaataaataacagaatcaatgactttattttctctcttaaatataattttcaattacacaaaatgtataggaatctcttcatttttaaaaaatagaatactacagataaaggctgaagttccatccccaatcttggtctccttccccccactgtaaaagttagcaagttaggggtctggtgtccatcaaaccaagatttttaaagaaactttcacatacacaaatatgtactcatagataatatatcagtttttgagattgcttcctactgcaactttggggcaatattgtaagtgaccgccttgatgtatttgaagatgaaggtgacagttctcccccataacacgtggtacagtttggccaataggagggatttctcttcttcaacactgacatggtctgaaaaaaaatcaacttgccccaatcaggcagcccatccgtctgctctcatgcttgtcatgaacctaaatcaatcagccagggaatttaggagccaattgtcatttctcatatcctcatggagaagaactccatctgggacaacttgttccagcatgatttgggaggatgacagccaagaatggtttagttttccaacaagggccacgtgcctccttgccttccttgccaacccccacccagtacctctgttccctgctacattccctacgtaaggaatatttgtatctggggagaggaattaggagaaactcaggtctctgagaggcacaatgttttgtctgagtttgcaaacgggacatgggggcttccagagttccccccattatctactttggaatctccttatcctggggcagccaaggtcaggcttgctgcctgggggcttgaccacccatgggatggcccaggaacagagtcagaggccagaggaacagttgagagtgtctctatctaattcacaccttggcaccagctcacgggggatggtgcatccaatttacagcaggagcgtctaatgggtgttaggcctcaccagacacacaccacacacttcacagagtgtaaagaaggatcagtgaacatcctgcaaatgagtcacaaagaaacattcagaaccaccgatgaattcatctaatatttcaatacctagaatgtgagcagaatgtgtggcataatataagacaaggcagggcaaacagggcacctgcccaccagccagtggcactgtcctcatgactgtatagttatgaagccatccttatctcctggaggtgaaaatgaataataacatcactctaatgtgaaattagggggagggcagataggctgtctgaattaggaagctaaaatagcaaacagagtacggtcaaacaaaactcctggcagctttgtatctctttagttatcatgcttagtttatatacaagtaagaattgctaaagtaacctataggacctaaaacatttttggtaaaggtgttatatttgattaaacaaatgatcacaatactttgtaactcattccatcaagaggtggagtctatttctctatctgggatctgggctggcctcatgcctttctttcagccgtagaggacagcacaagtgacattgtgtgagtcctggtggccaggccacacggaatagaattgaggcaccaggctgatggtcagccagtccccagccaacctaccatttcacaaatgagcccagccgtgattgactgagcctggctcagggcagcagaagaacaactcggaggacccggatcaaactgctgacccacagaatcacaaattaaataaatgattgttgtttcaaaatagagagttttggggtggtttgttatgcaccaaaagctaactgttacgtattttaaaaacgattccaaattctattgacttgtttagccgacatcatttcaatactgcgatctatgaagaaagacactcggcattgtttttctcccattttatctccatctcctcaccctgtgcatacccctgaatatgcactcaacgtagatttgttgagtaaaagaacagagtgaaatagacttctcttgctggcactttaattttttttttcccaaatgaggcagggaataatgataaatacaagataaataaataaaatagaaaggaaaaacacaattaaactatgtcttaattatgcaatattcttaattaatggggcatggatggatgaattttaaagcatctgtgagctccttctatccacccttcaacaaatatttatttactacagaatttgcatttcgcactatgctcacccccaggatacaacagataaggaagacggatagcatccctggcctcatggagctgtagaaatgtacaccattaattctgcctaacatagaattaatttcatgttagaactgtaggtagctacagttctgggcacggcagctcatgcctgtaatccccgcactttgggaggccaaggagggtggatcacttgagatcaggagtttgagaccagccttgccaatatggtgaaaccccgtctctactaaaaatacaaaaattagccgggcatggtgacgcatgcctgtcatcccagctacttgggaggctgacacacaagaactgcttgaaaccaggaggcggaggttgcagtgagccgaaatggtaccactgcacactagcctgggcgatgagtgagtgagaccctgtttcaaaaaaaaaaaaagaactttaagtaggaacaagtaaggtcatgggtacatataaccataacaaatgccgtctcatcctggtacaggtattttcttgcctgtgatttgatttctgactggtgtctttaattttttcctgtttatttacattttataataaattcaataataatagtaatattactataatattgtaatattataataataatagtaataatagtttctaacaaatatattagtaggtatacataagaggaactaaacagaagtatttcctgacctcgtagttctttcggtctggtcagggagacagagattatatgtataatcactctactaagcaaataattacaaattagccaagtgccacaaaggaaagtcccacagtatgatcacagggtagcatggcctagtctggccggggaacccaggcacagcaagtggcttggtatgatgtcatcacgactctagctggtgagttttaggacattcttgttatataaggttttgaggacttgggactgagttttatggagtccatggacttgaactgttggcttgtaagcaccctgcgaccgtgtggttccatctccctttgtctcccatctcacagttgccatttgtgggcatttttccattcatgggagtgctatagctaaagtctagatattgggacaagagatcatggatttgcttcctgtgccccatttcccacgggtgagccactgaaacctctctctgccatggtccacctgtagaatgaggacacacgtcgcctccaccccaccccctcctttttcattatcggccctcctttgccatgtgcccttggggcatctggggtgccctgtggcgcctctccccccacccaggcatgtggcgaagatcactgagacgatgtttgtgaagtgccacatgtttcgagaagagaggcattctccagaggaattccatgagggattgtgatgattactgagcctctgtggagagacctccggtacttggcaaggtgccacccccttatctggagacagctgctgcctggctgcccgtgcacttgcaatcacagacttttctgcttcacatacagattgcctggggctgcagcaggcaacaggaggggatgcagacgagagctggtgcccacacctctgagctatcggtccatgtttattcattcaacaaatatttattgagtgtctactatgagcccttacatgagtctagacattgctggggcttgaaagcttataatggaggagagaaattgtttatgacttgctagcgatggggctcagcaccaagccaaataatatctcattaatccctttacagatgaagaaactgctgttcagtgacatatagaggagcacagagttagtaaatggtgcagctgagacttggcttgatgtcagcccaattctaaacactgtgatctttctagttctgcttcaggaacttacaaagatgcccaagatctccacctctacagaagctgagatccttaaacgtgggcacagatctgtatcagccctctggcccccagctcaccaaaataaacacagcctgtagaaagtcacattcttcccctcctgatcctggagccaccttcttaaaaaatgtctttcttaggctcaggcttgatagagattcccaggtgcaggcaagaggaatgttccaggcaacggaaccagcacatacaaattcacagaaacaacagagatgtatctacaagagtggacctgggtctgcttggtgaaaagggaagagtccaggaaagggaaagatcaaaggtacaagagaaaacaaaaaggaataattgatggtggcaagatgggatcaaaccaaacatccagctgaagtgataaagatgttttctgcacaggcaggaaggttagatgcaagaacatttaaattaaataaaggcaagtgatgatcactaggatactttaaaagaatggaaaaggtttggcagcttgagtagggaatgggaatgatgttggcaaatcatttgctgaaatgttatttaaaatagcaaaagagtggaacagcctcagtgtccagcaataggggagaacttaggaaaattctgagaaggatactggatgggatactatgtagctattaatagagatcattatgaagattttgtagcaccatttttaaaaggctcatgatgtaatacagtgggggaaaactatagaaaataaaaatctgctctattttgattcctaagtggaaaaaaacaaatagatgaaaagagaaagacaggggctgggcatggtggttcacactgatagtcccagtagtttgggaggctgaggcaggaggattgcttgagcccaggagtttgagaccagccttggcaatgtagtgagaccctctctctacaaaaataccaaaccaaaaccaaaaaaaaaaaaaaaaaagagagaaagagagagacagataagcaactccatggagcaatggttccagagtagcccacaaattccattaattacgtgatattgttggcaaaagtatgtgtgtgcacatgcatgtgtgtgtgtgtgcgtgcacactcactgtatgagtaaatttttcctgagatgaggtgagagctccaagatttcattactttccaaataggtctatgatcacatcaagactatagaggaaagttcaaatcattgtaccacagagaatgttcatttttggttgggattctaaagttctttgacatagctgaaaagtatttttgcctaacatttaactcccaacattctgaggacccacattacaaatgatttttgtgcgggcccaggactttgctctgcaggattcaacgctgacacactcatacacactcacacacaggcacacacacactttctctcccacagtgagtaatttccatctggtctcccagttctccttcctggttctccctcattagggaactcttctgaggagtgaaggaatctcttactaaaatcatttcagggacctcatagggctttacaaaacattaaatcgccacccaatgcatggtcatgggaaaatcgagctccatggctttggaaccaatctgaggtactcaaggcagaaagagatcccatgaggctattgaaccaagatggctcaccgcccagaagaccacatgcccttatatcaaggtggcacacttcacagcgtggagcaggaagaacagtgtgcaataaagaaaagaaaaataaccacttagaaaaacacatgtttcacggcttttgaataattaaaaatgatggtacctttgactgggtcatgtgttcaagctggcccacagagacatgaaaacattctggtgctgttctgatccagcttatagtccttcagtcaccaaatgtttactggccacctcccacatgcttggtttctccctttccatcaaagaacaagaaaatcatgtggctgtgggtgtggaaagaatgaaagggacttaaggattacaggtgctgtccagcccaccttgggcttgaatacctctatcaccagtcaaatcaacggtatcctctgagcctcattcttcccatctgtaaaatgggtggcattacttattatgcaagtcatatgagaactccgtgagtgaatgtatgtatggcaccaaacacaagatacaagcacgtagtaggtctactctgacatatacatagaggattaaggaaggtctttttttttttttttttttgagacagagtctcactctgtttctcaggctggagtgcagtggcatggtctcagctcactgcaacctccacctcctgggttttcaagcaattcttgtgcctcagcctctcgagtagctgggattacaggcatgtgccaccacatctggctaatttttttattttcagtagagtcagggtttcaccacgttggccaggctggtctcaaactcctgacctcaagtgatccacccgccttggcctcccaaagtgctgggattacaggcatcaaccactgcacccagctgcaaagaaggtcgtaacactacatccccttttatcacccaggctgttgagcagaataaatgaattaatgaagtatggaagagctgcaaaacaaaacaaaaagcctctgtaaaatgttacagaaatatcatgatatgagtaagctcctagcctgtgtaggtgtgaagctgcctcattttccaaaggtcacaggctccccattttacttatggtcttttcctgtgcttccaaagagtgtgaattcagttgctgtggtgagctctttttctaggttctagctgagccttggatgagctttatcatgctaagggtcaacatatccccagacagaatcgtattttaattcaacagcattcagtagttattaaactatgataaatgctaaagtgggaaagattacacttagacataagaagtgtcacttgaatcacttaaaaatattataatgtatggctaattgcaccttgactatattatccagtgctgtgaaaacacttcagatccttaagtaaggtaccatttaaatacctatttcggtatgtaatgggtaatattcttgagtgcaaaggttgttaaaggacccaatattcattgagtatctattatgtgctaggcactttgtccacattaattcatttaattctcgaaacaattaactcatggaggcaattattaccagccccattttactggtaaggaaactcaaattcagagacgtcaagtaacttgcctaaggtcacacagctgataaatggcacagctgagattggaatctgggaaagccatctccagaatccactgtcacagacagatacaatgtgacctctgtgacttctctgcctcagtgtcctcacctataaaatggtgtcagtaattatactaggtttttgtgaggattgagatgagcgagaaaagctcagaacacagtgctcagtaaacgaaagcattattttctattgtcattattgtctcctaaaatgccattctatcacgcttaagctaacaactccaggcctggggtttgctttggagagaaatactttctacttgccagcatggatttagtagggttgaaacaatacagtgcacaggtctaggcgcagaactggctacataatttccatggtccattgcaaagtaaaatgtggtgtccttgtcaaaaaacattaaggacttcaagatggtgatggcagcgcactgaaccgagcaccgggcttctaagcatcagaatctttgcaaatgcacaaatcgaatgcccgtgaagccagcacccatggtgggaatcgaggctgccttagctacaatctgtggtcttggggaatgcagtggaactttctgagtctctctgattgctcatcagtaaaatggagaccattcctgcctcacaggttataggaagaaccaaacaagctgttggatgaaaaagtccggctccaccacaaaacagcatgccagtgcttctcaatcctaaccatgcaccaggaccacctgtgagcctgctaaaaatgtagatgctggtggctcttgctcctgaagatttggatcaggagggcagggctgtgcttctgtgatattaaaaagttcaaggtgattctgattgtgctaacaagccaaagatattctttagtataagaacactaagcttaattacttagaattaggatggtcctttctctctctctctctctctgtctctcaactattacagtcaaagcatattcgaagagccaatcttttgaaactcaccctatgaaattgtttcaatatatcgcttggtcagactgtttgtgatatggctccaggacacacaaaagatcccttttatgccatcagacattggatgattcctcacttgcaactgtaatgtcaaggccaaagttttcacactgaggtcagtgcctcccacccccagtcttccggcttcctgctgccaaataactagaacagaccagtgccagtgagaatggataaaccacagcagcctttctttggaaacacttcagtcaagggagaaaactgatcatcatatggtgatggctttcatgccacctggcacatgctcctgtaactcagctgcattttcacctgggtgtcagcttcgggagtcagaacggctacatctgacaagtcacatgcatcctctcatcaaagccatttgatttttttatttttattttttagcagactgcgttctccctgaacaaaagtattaatgaaggttcgagcatatgggaggcaggtttaagacatgtgagagcttcagggcagtggggacaaggcaaagctggcacatacatgtgccattaatggggtgtcatttgggtggcacataaacacaaataggaagctcagagctccctggagtggctagctgggggtcagtaaagcccgtgtgctaaccccataacacgatgcaagctcaactcaaatttccaggctgtactttttcccctactacatatactggggctgtcagtgtgattaccaggttatgatggtcaactgcgggaggcttctatccccacggtgccatgcacagctcagcatcctgatccaatcaaagggccatcttggactgtcatggacactgctggctcctttcttttggcacttgaatgcttaaaaactcaaccaatatatgcctcactggccacaggtctgtccttcactttctctttttccagtcatctcagacataatgggttcctccctgttttttggacaatctgtgatggatgtatgggtggctgacaaccaagaggtgcaagatgcttgggaatgaagggagcaaagaagctctttgagataatgctctcctgattggaatccttttgggaagccaagtttttctctcttaagacctcatcattggccaggtgtggtggctcatggctgtaatcccagcactttgggaggccaaggtgggtggatcacctgaggtcaggagttcaagaccagcctggccgacatggtgaaaacctgtctctactaaaaatatgtggtggtgcgtgcctgtagtcctagctactcgagaggctgaggcaggagaatcacttgagcccaggaggcggaggttgcagtgagccgagatcgcaccactgcactccggcctgggcaacagagcgagactccatctcaaaacaaaagacctcatcattgaattgtagaatgttgcatatgcaaaggttcttaaggtcagtcattccaacccccaattttttattttattttttgagacagagtctcgccctattgcccaggctggagtgcagtggcgccaactcggctcgctgcaacctccacttcctgccaacctccaattttacaggtaaaaaaaccgagtaccaggtaagttaagtgagtttcccagtgttaaatgataagaagtggcacaggcagggcaggaagctccatccaccaaaaggaactggtgcaccgggtgtacccctcagtccatcttggtttgctgtagcaagcactagtgaggctcacagaggcagcttctgtggaacaggagctttcctttatcatgcttcctttaaatatggtttcttcatcctcatgctaagcccattttccatacctcgctccacttcctggtttattgctgcctggtttggggccctgaagtcaatgtcactggtaaatagttcaaagtctctcttgctgatcgcaatgccctttccctcccattcaaggtctcggcccagcccctctgggcaagcagttaagattttcagtggctatgagcccccttcctggacctcttcactctttttcaagcctaaacatcagtgctgcgttcacatgcacatgtcacgcgaatttttctactctttccacttccaacatagcttctatttccaagaagtcaaagggcttttcagagtccataaaagtctatgtacacaatggcattttatactcagcagtcttccctgggactttttcattttctgcaggtgatccggagttgagaaatgacttctaaatcctgtctactctcatggctgattaaagtccagaagtccctgtagtccgcctaccagtacttttgtgaagattttgcataactactgaaaacagtttaaaagatcatgtctgtgatctattaaacaaggtttttttttaagggcaataaagggtttaaaaggaacatgtgagacagaaatatctgcgctctgcttattatacattagaaattataagaataacacgtttactactaattacgcaagtcatttgtcacgaagctcttgccagaaaacgtatttgaattcccccaaattcaaataaagaattaatgggtaaataatttatactcaagtaattatttgcaagactttatttaaactagaatttagtcaaagttaattcaaaggttttattccttgcatcctgtaatgaagttgttgtttaattagaatgacaacttgctcctctaggtaaaaggaaagggaaatgtaaatttcagcgatgattttctctggctgctcagaataaccatggccaagatggcccatgattttgaggaaggacaggaccttggatgattccggtgacactggagagaagcacagaatttccacatgaatcacagtcctggggcttaggggcatttctttagtaggaccgacacaaaacaaaaatagtaatgaaaccctcaaaaagctcgcagccatccattaacacaaactcagtgacacctacatccgaaacatacaccctcgcatgcagacaccttcacacacacctcttcctggctaaaataaataacagtcccaatcccacccctaatgacaaaacacatcccagatgctgtcaagttgctttcacagagtttaatgagttgaacatccagagacacacctgtagttgccactggtcctgaggcttctaacttttccagtgtgaaaaattagagacacctgggcctggggacttatatttgtggggcgctggtgaggaggtttggggggggggtggttccaaagtctccagatccattttctttaagagagagaaattgtcgactgcttttcaccttccacttctcaccaattgggtggctattcatttcctagccctttggccgaattgtgctatgtttcatgaagcatcgctctcaggtcaggaattttgggtgagatggatcaaataggaagagaccaaatgcattctacccccattgacctaggagccacgagcatgcagtggcaaatggtcctcaggagatggacctttgtggggcaatatggaagagcctcttaatactgtcctgtccatgagagattccttcaggggtgaccccaaagagtcttagcagatcaggatgtggaaactccccggggatcctgtccccttccagttcaactcctgctagccagaaaaccgagctaccaccaaatgaactggattgccaaagaaaaatgaaagcagaaagtataggttctgctaaggacaggtgcatgagattatctgtgttcaaagaataaaatgaggcggtacatgataaaaattatccttctgtgcctcaggccatgcctctgaacacatctttggttcagaaatttacaaagagggcttcacaaactcccatctctgacattactatgatgtatgatttccctacacaatacaagaaagtgtagctggaaattttgagttaacccttcagactattaatgattgtgcaaactttggactcaaatcacttacaaagctattgaagaaagttatgctgctaaaataaatgctatgttattgcacatgagattgacaggatctgcaaaaatcaaagctacatagtacgtgcactcttgggatgagaacggggatggaatgcagcatgcacggggtaaactgggatgcggcagatttgccagatcctccagcccttctgcaggtccatcagaatcacctatcgacgcagaggcaagaaaagcagttagcgcagaaaatgagggagccggcgacaggaaaaacgtgaagcaaaagagagcaggtgggttatttcttaaagaatgacatgtttggaatttttaaacatatatacagacatatatataattgtatagtatatgaaattatataaattatgacttagttttttttgttacagaaaataacaaacctccatgtattcactgcttagcttcaacaatgatcaaggccagtcttgtcatcggccattcaaggccaggcttggtcattggccattcaaggccagtcctggttcatctattcctcccactctccttcactttattattttgaaacaaatctcagacttaccatttcatctgtaactatttcagcatgcatctctaaaacaatgatacagtttaaaaacataactatcataccatgatcacacctaaaaagatttccttaatgtcatcgaacatccaggcaatattcaaatttctctgattgtcctatacattttatttttgaagcctgaattaggatccaataatgtccttacattgcaatggtcgataggtctttttaagtctctttaatcaatgtggtgaactttcaatctctttttgtcctgggtttttaaaaaaattgttgttgaagaaactgggtcgttagtgctatagagtttcacacagtctgattttgcagattgcattcttatggtggtgtttacatgttctgctgtctcctttctctctggtaaattggtgattagatccaatggcttgacagggttaacttctttggcaagactgtgtcataggtggtggtatggatttctatcaagggatttcattgcctgctttgatctcttttcttgatgtgaatagttatttataataattgcttacatccgttaattctttaaggttcacaaaatgggcatcttaattctaacattctttctcttcttcctccttctccttctcttcttcctcctttttaataaagctggaatacttctattgcatgaattttccccccatttggttaccttgaggttttggttttccttcattcattttgaatcattataaactcacggatttaaacatatttgatctgtgcatttcaatcgattgaaattcatggtagttatttttgataatcattttgtgtcgtctttggctgatggcacttcaagttgactcatgcatccttcctttttgatgtgacaaaatgttctggcctcatcttgtatgtttccttcctgagatttgaaactagccatttctccaaaaagccctgggtccttttagtgagaagcagtatttagaagccataatttggatgttagggttggtcactgttaatgggttagtcaccctttccaagccttttcagtgaacacagcaaaaattgtagacacacacacactccatataatatataacatgatataactatataggcatttagagatatttaagataaaatacattataagtttatactgatacttcccattcaaattcagttacaagtttttatttaactttattgatccttcagctgtatctccttttctccatgctaaaaaatctcaattatccatgataataatctaaatacttatttgctttatcccacactagacacccaatagtcccaggaaaacagaaatccaaccatcagcgatatcattactgaaaacagcttactatttttttataggtctttttgtccttaaggatgtacatcaaattactatgctttaaaataatttagatggatccttctctgtgatcatgccatccactggatacaccgttgggttcatttatttcatgttgattttgatttgaaggatagctttctaaattttacttttggtttatacctctgtaaatatttacatatgtctgaagtcagatgtacaaaagaaggtatattcagagaagtctatctccttgccatcatggctatcctgttcctcctcctttccactacaggtaactttaagataagttatagcttactcttttggtttctttttaacaatacagacagctgcctttttatgttagattttatataatttttttgttatagaatcagcagttttatatattatagaatgaagttttctaaactgttgctggatcataattgctgaagtacagttttaaatcctagaacagttcaaatttaagaaggtcattaccgacttgttacaattctttaacattgtagaaaatgcttgcaaaattcttttaggttctggaccattttctctctctgaccttcactcagctcgtccgtagaatttttcagccatgtcagcaaggcttctaccacctacttgctgaactttaattcatttcattttcatgaaaggaaggaaatcccctgaaatcatttattagttcttctaaaaaggcacagccatctgggactttttcatgtttgttgtgtgagcagccatgtcgtgctttttgcatcattggctggagtcaatgttgaaatcttaattcatggtgtttataatggcaacaaccgtacgggaagatttacactttccaggaggcgtggttgagaggcggatggaatgtggcagtcgtgaggaggaggatgtgcatcttctgtgtcaatggacgacatagtagatgacccaccttacattcaatgtcctgctgagtaactgatttctctgtcttgataattataaaactggtcagagagttgctccatgatctaagacattttactaagctgccaatatattatggtaagaccttctaattattgccctttaatatcctgggctttgcaaaacagtaactccaattttttcagaaacattttcactatcatgactgctttttttttttttttgagagacagagtcactctgttgcccagtctggactgcaatggcaccatcttggctcactggaacctccacccctcatcttcaagtgattctcctgcctcagcctccccagtagctgggattataggcacgtgccaccatgcctagctaatttttgtatttttagtagagacacggtttcaccatattggccaggctggtcttgaactcctgacctcaagtgatccacccacctcggcctcccaaagtgctgggattacaggcgtgagacaccatgcctggcccacggctacttttgattgctgcaacagtgtccccagtggtctccctgctttcactctgtcccccacatgtgaccatcaaggaggactcagacctaccaggtattaagacttaccataaagccacagtgattaagacagtatcagcacagagatggacaactagatcaatggaacagaactaagagcacagaaacagacccttgcacatttagatgcttgcttcatgacagaggtggtattggaaatcaatgtgtaaagatgagcaccactgtctctgcacatctttccatctcagctgccattcacagacatcactttcagtagctacttggtactcagccgtatgaacataccatcatggtaccaccatttatttaaccaatccccatcccttaacatttaagtgactcctttgtgttttttttttcctattataaacaatgctgcaatggagatttttgtatttaaatatcttatacaggccaggcgcggtggctcacgcctgtaatcccagcactttgggaggctgaggcgggcagatcacgaggtcaggagattgagatcatcctggctaacacggtgaaactccatctctactaaaaatacaaaaaatgagccgggcgtggtgccgagcgcctgtagtcccagctactcaggaggctggggcaggagaatggcgtgaacccgggaggcggagcttgcagtgagccaagattgcaccactgcactccagcctgggtgacagagagactctgtctcaaaaaaaaaaaaaaaaaaaaaaaaaaaaaaaaaaaaaaatcttatacacatacttatgtccttagttaggattaactcatcagatggagctaataggtcaaagagctcagatattttgggaaagcatggtccacatttctttcctgaaaggcctgctactcccactaacagcctatgaaagagtcaacgtgcttcctctgacaacttggaatatcattactttaaaatctttttgcatttcaggagtaaggaagggtaacatagttgttttaatttgcatttacttgataacacataaagctaatcattcatccccaccaaatgattggccctttaaggtttttcttttgtaaaatatttgtttttgttcttatatggttactaaactgctctttctcacaccactccaatccaccaggtatgacactgtgaaattactatctctaagtaactcttgtgtacctggtttcgctgttctaagaaattctaaaggttaaatgctaaaggttaaaaaaactataaaaatacgtacagataaatttaagataaaagacatgcttcttgcttcccgcaagataagggccaaagtctttaaccagaggttgatctgcaccaaactaacctcagtattctcttccaccataaccctcgtccttgaccaacttggtctgctctctgttccttctccatgtgacatattcctccccccatgctttggctctcattgctctcatctcagaattttcttttcacttgctcagtttcttatctccctttatgccaagctcaagtgcattatccccttaaatctttccctgggagaatatcacctctgaccttccgagatacttactgtagtaccttcccatgcttcatgccatctacctttttaagattgtccttttgggggcacttgttctaactgaagtgtaaaactctcaaggaagaagacagtacaccttgaggttcttttatgctagtgtttcgtacagtcccaagaactcagtgtgtggatgattctgacgatcccacgaaggaggatctgtcaatggcatgttgaggagggggagatgagatttctatacccttgtatctgcataatcccaaatattttttaggatgtttttactgaattttcagatgtttaacgataatacctgatttcttagtcatggaggagtaaaggtgttaagggcaagtagaggttatagtgaagtctgctgaagttggtaagcagccattattgggtcattctggaatgccttggctttttacttctattgacccccaagccccaatctcagcacaggccccaatctatcaccccacaagccccaatctcagtgctgtattgtgggctggcagactctggacaagggaaaagcagcatacaatataaaatggaataaaagccaagttccacctctgctacttacaggctgtatctccataggcaggctacctaactctcttcacccacatagcagagacagtaatatattccccaggattcttgtgagaatgaagtaagacaatgtgtatagagtatgcaaagttatctccacagagccagaactcaatgcatggaagctatcaatgtaagcagaaaggaagaggaccctgctggtcttttctgtcttggcatgaagcaagaggttgggtcaacatgagcaaaaaaataaagtcaggcatgtccaaggtaataagggacaaagggtggagtcttatttggggtccactgctaaagcacttatcctactctgcagggcactaataattcctgtgccaactcaggggtaaattaggatggaaattgcagagtgtctgtgcaatgcttacttctgaccgaaggcagcatccaggcctactgagagtcactggaaacaaccaccagaaattttggagactaaaagcacagtaactgtgaaactcctggaggaactctagaatatagctacattaattgattctacaatgaaaactggcaaaggagggtgaaaacgtaaagtacagatgaagcataaccaagcacaagagaaagcaaaagtagcaatgtggacatcagaaaaaaatgaaatttaaggttgaaggtataaaacagaatggagaatgacattatataatgttaaaaagcacagctgataaaggacatataatatccataaacctctatgcaccacacaacacaacagttaagtatataagggaaaaaagagcttaaaatacaagattttaatgaaaataagagttggaggtatccatagacatctctcagaattagacatatttacaagacaaaaaataagaacagagggaatccaagattttttaaagagctcagtagaataggtaacttgctatggttatgttatctgcagaactagtgaaacgcactgacacaagaaaatgaagtcactgtcatcaatattgagaaaagtagataaaattatcacttttgtgttgatatatctgaatacctagaaagcccaagagactctaatgaaacactagtcaaataaattagacaacttagtaaagatagtaaagatgaatacacaaaaatcaattgcttcactctctactagcattaagcacccagaaacgagaatgggaaaaaatgacaagagattaagaagtttaaaaaactttaaaaatacttagagagaaatttaatgtaagaggaacttgagtggccaggtgcagggactcacacctgtaatccccaactgtttgggaggccaaggtgggaggctgatttgagcccaggagtttgagaccagcctgggaaacacagtgagaccccatctctacaagaggaacttggacccagagttatatattcctggggtcactctatcctcaccagtgaggtctgaatttcaaccctaggttctctgttctatctttgcttgctctctttcagtcctagatacagtagctgcttctcgcatttactattcctatcttccttagagtcttcttttaactcttttagtagttaaccactattttactagttaaaaatcttacataaattttccctgtttaaattactggtgtggtttctctctccagaccctgactgatgcagacctatatgaataaactataaaatcttattgaaagaccccccaaacaagaactaaacaaatagatatcttctcagatagaaagacttaatattgtaaaatagcttttcttcccagaaaacatatataaatttaatgatattctaatcagaattccagtaacattttcattatttttggaaacggttaaaaatatcttagattcttttggtagggtaatttcatgaatagctatgaaaagcatgaaaaataaaaattgtgatgagggatatgactagctgtatataaagccatagtaatcaaatctaagtggtttgggcagagagagagagagacaaagagatgagtggaaaagaatggaaaaatcctgggaaagatcttaggatacattggaatttcatctattacaaagacagaatttcatttcacagggcagaaagtgatttatttttaaaaaatgggctggcaccaatggctagtcatctagagcagagattggcaagctttttctataaggagccagatagtaaatattttagaccaggaatatccaatcttttggcttccctgggccacattgcaagaagaagaattgtcttgggccacacaaaacatatactaacaataacaatagttgatgtgctaaaaataagtaaataaataaaaaataaaagtctatgcataaatctcaaaatggttaaagaaagtctacaaatttgtgacaggccgcattcaaagccatcccgggctgcatgcaacctgtggactgcgggttggacaagcttgtttagactttggtctaaaatattatggtctctgctgctagtacacaactctgccattatggtgtgagagcagagctagacaatacataaatgagtgggcatggctgtgttccaataaaactttatttacaaacacaggcagctggcctgtgggccatagtttgtcaacctctggattagaggaaaataaagtagtcccccatttctgaccaaatacagaaataaattccagatggagcaaggacttaaatgtaaaacataaacctcttagaagaaaaatccaggtgcaataaggtatgattatattacgaagggtatccatcataagtcagaaaattcagaagccataaaagaaaagctggacctatttgagtttataaaaatgtaaaacttttatacgacgaagatgttatacacaaagtctgaagataacagatttgagaagaatgtttgcagtacagatgacttatatctctaatctacaaaaggctcttaccaattggcaagaaaaagacaaacaacccaacagaaaaatgaacaaagggtatggattttagtttaagtgcgattggagcccttggaggtttccagcaagagaataatatgatttatgttttaaaaagcccactcaggctgctgtgtggggaatggattgtgggggggcaggaggtaatcaggaaaccagggaggctggctggaatgtttttgcagactaccccacttgccccaagagaaggcttaatagatgttcaataaatgtaggctgatttttgatgaaaacatctgtgccataccccgctatggaatctaggccaagtgtccttgagctgactccttgatcctttccttgagggtatgtgaggttcagaacgtggtaagactcttttcaactttcaatagaaacaaatgtgtgtctctggttgatgaaacccaagagctgggatgagggctacccctgagaaatcctgccatacttatccacacctcagtgctgttgcccctcttggctctgattatggaaaggggaggcaagaagacctgttgcagtctgaaggaaccggtgaattcttagttaaatgaggcaggacacaggagacaggggatgaaactgagaaggaagggggatcctaaactaacacaggagatgacagagcacatgcttggccgctctccacatccccacatggggaggagggggttgcactgaataatctcttctcttaaggcttggggacccaatgacttaactgcaagtcatttgtctgcacgtgaagccaacagttttcaagtgatcagtggtcaaaacgaagtaacgacttgcttctcctcagctaggaagtgggtttggaaactctggccacccatccagcagcaggaacagcagctggagtgacaggcagcacaaagaaatgtccctccctccctctgcaaggtttaggaagcccgaggcaaaaagccgaggctgtagagcggcactgggcctggagctggtaactcaggctccgtgcagagcctccgctttttcaaatgtaaaataaaaaacatcctggacaggagggatctctggagaaaaatgaaagaacgcacacagacgagagctgccggggagaggcagcggagctgacattttctgcaaagggaagagaatagcatcaccgcagagggaccccgcatccagcaacagagctcttgcggctcatctttgtggaggcctctctgtttcccgaaatcccttgtggagcaagcacaagaaagtggatccgaaggaactggaggggtggggggtgggcagtgttagctcccctccaactctgcccctcacagctgcatccggccaaattgaggatgctctattctccatgactgagcctgtgtctggtttcccagggagatgggcacaatggaccctgcttgccaacgatgctggtctttaacaaaacagcggtgcctcgtgctctgcacaaacacacatttctgcacacccagaagaatgcatgccttccaaagagtatctgccatgtggtagacactcaggaaattcaggatcctgcaatcattttaaaggcctcccaaatggcgagtgctccacgaacacacttcaaagaaagaaatgaatgaatgagcagattattttggaatcacgttctaataatccatctggatatgtagacccccaaacagaggcaacaaccatgtgaattcaattcctgccatgatgtcagatgctcttggccaggaattggcaaactgcagcccaaggaccaaatctggcctgcaccctgtttttataaataaagatttattggaacactgccacacccctgtgtttacatatagtctatgggctgtttttgagctgttaacagtaggccagcttgagtagttacaacgagatcatatgggctgcaaagcctgaaatatttattatttggctcttcacagaagaatttgcagactcttgctctaggcaacgtcctggatttagcaggtctgaggtgaggtcaaggatttcatgtttctgagcagctttcacttgaagttgatgcagttagtcttggagacaccctttgcgaagcaaggttttaggcactctctttttccaaaacaaacaaaagtatgatgaaccattaaacattaagtaccaatcctgtacacagcatgaacttggccctgcagtatcacataacttgagtcagctgtaatcaaagaaagtcttggacatccctgtttctcacctcataggcctcacttactgataggagcctagcagcatacacagcatacaccaaggaagagactggaacattcctgtttagttcatcaacagccacaaatctagacagacagctcagtggacattcattgccttttgacttccagcatccattcattcctcacccgaaggcagcaattttgaaatatttctctcttcccatttccattaatgtgctttgggcagggctgactccaggctcagcccaatcagcatcttgcatccctcctacgttaccctgattggttcaggggtgaacacctgacccactgggttcccatgggacttttgcggggacttctgtgaaaacaatgttctctctttcctagagcatctgtagtgagacaacatagaatctgagctgctgtacgcatttcatgacgctaagaaggcacactaagaaggaaaagaacaagcatggaggggacagttccaagcaacacaaaggagaagaaacttggtgactttgtttaggctcctgatcaaatgctacccctagccacaggatgttcccatgggtttttcagttatatgagcccacacatccctttttgcttctgccatttagagttccaatttttgtgctttgcaattgaaaaaaaaattcagataggaaaaattactaaaactttccgtctgactgtggctgagcaattagggccatgaacactcctgcatgtttggacacattttggcacatctgcaggaggagcatgaataaacggctgcctgtcttggagctgaggcacttgctgccttgaccatcaccaaggctgctatcacttataggccctggcagctccaatctctccaactgcaaccagctcatgtcaaaacagtcccgcagtttcaagaaaaaggatcctgggaaagggttcaggaatcctgctacgagtcaactgagcaacgtgttaggttttgaagggaaggtgagggttaaagaaagacacacacagagaggaagtggcagctatacagcaaatgcaggctttatgtccagcataagacctccagaggtggaggaccagcctaatgccagtgccccccactgcttacaggctggggtactcacaggtatgggcaggaggggcctgggcaggatggcttgctgcctgggatgatattgctaagacattgccatgatgaggcagtttggcctttgttcccacggaaggtgatgttccttgcactttctcccagcagggtatgataaggatgttcctgtgccttgtggtcaggtggctgggcaggatgtgtctcatgccccgaaccccagtggaatgtttcacttgaccaagatgtgtgaaatggtggggggtggggggttacaaaatgatgcggtttggtctaacacaaagaagcactaaagaaactaccgaagggtaggtcatctcaggcgaaactataccaggtaatgttttctttagcaccattccatgttctcttagcatcttcttgaccctaaagtaaccaatgctcactctcgctctctttctctctctgtttctctcccaccgtctctgtctctctctctctctttctctctctgtttaactctcttaccaaaacaactttcaactagtaagcagataggaaaggaccttattaaaaaacccacaggactcaggttcaccagttttttaaccagatagatctggatttgaattccaggttcaccccttactagatgtgcatatatgaataagcaacttaaatgctctgaatccccgtttgcttatttttttaaatatatgctttgctgagttatcatagggagatgagataaggcatatagtggttacgtgtaagactattatcaaaccataaaaataatattacggacataacattaatattgttttagcctcctggaggtgtttgcattttcatagggagcaattcctttcttaacccaacattaggaactgtaaagtcagaatttcagcctcagcgacagacctattgctaggtttatatctgacaggtggctacttaaagaaggggttcaagagccctacacagtccttaggcaatgaccctgagaatcagaaactcaggccatatatgtggaagcaaaaaaaaaaaagattctagagattggaggagttgctgagtgacaatcaggctgtcatcactgaattctgatgggctacctggaactggcttagggtgggattacatacgcctcctgccacatcggatttccttctattttgtcaggggtggcatcatccagtgagtaaatctgttagtgatctccctcgcataacctaggaattctctcaggatccatttttccagtagttttgagaaagcgaccaacaacagcaaagagagtagttcttccattccaagagcagccatcttgcttaactgacaaactagagagaactgcaaggactcagtacatccctggcacagtccattctctctcacagcatattgtatgagactgtgtgagtgctgcttccacgctacactaaaaacccatggtccctgcattatttgagcaactgacaagcttctgaagttcaggttcgcgaacgctgagagcagcacccagtggatttgtggcaggtgagcagatccttctcatctcccattgtggaaatttcacatttcattctgctttgtgaatcccacaacttcatgacaagatagattaacattttgcaaaaaaaataacaaataatgttctgcttgagggaaaatcagacattaggcttcttataagaaacaaggggtcatgttgaagacttcaggataacatatcttggagaagaaaaagccattcagtggttcactccccaagtctgtggcagggtttttttgtttttttgttttttgttttaaaggttattttcataactttgagactacaattaatttctgtaaaacccacggaaaaatagcctcttttcaataatcttccccccatctttttccccaagagtctttaaatctgagaaaatttttcttttcaattaaaacaaaaaattgaacagatgtgcctcaagagggctggcagtacttttaagaactggtaataatttatttagaaccatgtatagtaatataatatatctttatacacaagtcgcacataaacacccactgcttttggtgtggtacttactgttccttgttggaacacccaggaaacttccatatgtcagagatcatgtatgacagtcctatcttctgtgtaaaaggtcatctcccagcagaagaatagctcgcctagttaaagggataccaatttttaaacgctctgccaagctgaagatggagagaatgagtgagagagggagatgtcagatttcaaatgcagggcacgctcattgtgccctcggatgctgagctgggaggagggggagagaaacctctatttagagatgattggaaaaaatcagtgccacacagtgcacttgagaagcaatgcggcaggctattcttgccctctccttggatgtgacaaaatggccaccatggaaacaggaagcagcagcaaatggctgccacaggtcttcttggatgcttgaggaagtgtctatgtgtatccaggcctgtgtggagtattcctagggtagcaggtttttaaagtcagggtgaagaaaagggaggcatttagaaggaatggacaattgacaaagaaagtggtcagacagcaccaaagggtaatgatctgggaaaatccaaggttccaagaaagtacgttgaccccaagaaacttagaatttacagtattttagccaccttgaaactatataaccatgccagctcaagtaaccaaaaatatcctagtccctgcactagccgcttttgaaatatcctgtttaaaatgaccccctcaccaccacgggtaagttgccaggggattggaggctccatggagggctatccctaagccaacctgccaggcaggcaggcaagtttctgccctccccaacctccccctgctagctcctttcctcctgagagtcgaagacttcctgatgttcctggttgcatcagacaccaatctggcccaacttccctattagaaggcctctgtgacaaccagccaatccgatgcaccaatctgagtaactgttttccctccttcaggacatggttacatttagttcgatcttttccttcccaaggcagatgcccaaagcaaaaagagtgaagcagtcagaatttcagacactgtgaacaactccccttggggtacctctggggctggcgtctttacatcacgacgacagaaagctggcccgcacagactatggccacggcgtcttagaggttttgtttctctgcaggcgtccagtgctctgtttctttccctcctcaccactctccaaaccacactcacacaaatacacgtccctatgtgcaaagacgcgcatatgtatattgtatatcagtgtgacactcacacatacgtgcggtgttagcatagcctttccccctcgagtccctgttgtgcttcccagcacccagcatcctccaaagcaggcagtggcacactatcactcataaactaaatccagccactgcctgctttgtaaataaagttttgctggaacacagacctgctgattcgtttgtgtatcgtctggctgcttttgcactagaacggggtggagtagccacaaaaaaagaccatgtggtctgaaatatttgctcactggcacattaagaaaatgtttgctgccctctagtctaaagcagcatcttatatctagaaaatctattccttaaaaattgtcaaaaggtctttctcttatcttaaaagtgattcataaacctgtacctcttagagtcatggagccatgtaattagaaggcgtattttagattgttagtcctacttatggcctagtacgtgattctcttctaggatacctgtggacgtctcatctctcttgatggttccagtaaaaggcaacacacagctgctcacagggaagctgtgatgtttcccaacagctctattggaaagttcttttttatccgcagtgaaaatctgatttcctatcatttccacccactggttcccattctgccctttggggccagtcaggaaaagggggacgatcctttttgaaaaatcggccaggcatggcagctagtgcctgtaatcccaacgctttgggaggcagaggcgggtggatcacttgaggtcaggagttcgagaccagcctggccaacacagtgaaacctcatctctactgaaaatacaaaaattagccaggtgtggtggcgcacgcctgtagtcctggctactcaggaggctaaggcaggagaatcacttgaacttgggaggcggatgttgcagtaagccgagattgcaccactgcactccagcctgggtgacagagcgagactctgtctcaaaaaaataaataaaaaataaaaaaataaagcatcaagtatctggaggtaactggcatgcctcacctttatattttgcttctccaggttaaaaaataacccgtccctctacctgttcctcaggtggtgtggtctcaaggccccaccacctctgtagcatctcttggtggttaatatccctcttaaacttagaaagccatgagtactgtgaagatatcaggtgctttctcaagatgagcattcattcctggtcaccatggtgctgagagttcaccagtgaagtgttagaagcttctggagggcaggagcagaggcttgctgctgtctttctggagcagcaggcacaggcacagggtagccccatcatctcatcgggtcccaagatgccctctgaagctggatatgccaagctttgcaccggtggctggaggcctagcggggattccaccggaaatctggttctagagaatggtatattttgaattaaccactcaacaaatcataaagcaggattgtcagactcattacgggaaaagctgcactgaaaataatgccttaagtatgtgttgttgctgctggggatacaatcggtattagtggcttaaggggctcaggaaatttccatgagaccgtaacaaaggaacagccagcatttggtgggaacaatggaggatggacccttttctttcatcaatgaaaggagatctttcttattatttaaaaatttgcttctccaaacacccacttctccccctggtgtaccatgtcagagttactgaggaggttttaaaaaaaatcattaaacaacccccccaaaagagggctcaatgaggtctcattccgtggtaatgagctccaatttaacgccatcattatttctgacattaaaggcccgagaatagtgtcacatgcccagaagctatttttttttttttaaaccagctaatcccagaaataagaaactgccatgagggacagtgagtcagggcctgtaaaagtgctttaggagaggactgtggcaatagactgacctgagcgtgggaggcacagcctgcacaaggcccttagccaccttgggcggacaggcccagcttgtgcagtgactgtccagtgagtcattaagaccctaggttttggccagacgcggtggctcatgcctgtaattccagcactttgggaggccaaggcatgcagatgagttcaagactagcctggccaacatggtgaaaccccgtgtctactaaaaattagccagccatggtgatggacacctgtaatcccagctactcaggaggctcaggcagaactgcttgaacccaggaggcagaggttgcagtgagccaaggtcatgccactgcactccagtctggttgacagagtaaaactctgtctcaaaaaaaaaaaataagtctaggctttgtgttagattctaagtttgaggcttagctgtgctgcttgtgccaaaaccttatgactttagggaattttacttaagttcctcatgccttggtttggctcatctgtaaaatggaacccataatagtacctactaccaggtggaggcaaaattaaataggatgcagaacacagactctaacatatcaaagagaagaaaggaacctacaggatgatggacagggagggacatctggaagcaacagctgggctccaggcttagagatcaaccagtgccaaggggggcagatcagaaggctctagaagaactttcataagaagacaaaattagtagaatgcccaatatatctggatacattgagagatgatgcacacaaccggggaagacttcaggtatatgtcaatgacagaagactaagaaaagcaaaaacagaaccactgaaaacagagtcatttgggaaaagaagagtaaacagaatatactacatggctcagctaggctaaatattgatctgataaaaatgacaatatcacgatattggcaagatgggaattttatgagggttttttgaaggggaatttaaaagagagctgggccctcatttttcacagtgggaagtcagtagataatgcctagaaataaaaatcaagaaacagcagcaaggccaggcgcagtggctcatggctgtaatcccagcactttgggaggctgaggtgggtggttcacttgaggtcaggagttcaataccagcctggccaacatggtaaaaccccatctctacccaaaaacacaaaaatcagctgggtgtggtggggtgtgcctatagccccagctactcaggaggctgaggcacgggacccttgaaccctggaggtggaggctgcagtaagctgagatcacaccactgtactccagcctgggtgacagaatgagaccctgtctcaaaaaaaaaaaaaaaaaaaaaaaaagagtgaaaaagagaaatagcaacaaaagcattttattgagagatatggaggtaaagttctaaggaatcagtttaaagcactaaaagagtttatccataagggagtaggagctagataggggattttgggggagaaattatatatatttttgcaacaagctggaaggactatataaatctaaaaactgtgtatgtaagtaactttgataacagtaaaactaaataaaattcctattgaaatggaccccatcaattgatttcaccacgagttcctctggatttattaggattaagaccagatttagcagtttctctgttggctgtctcaaccttctaacagatgaaacgtcgaataaggcaggtcaagagcatttccagaagtgtatctttgttttttgtttttttgttttttgagacagtctcactctgttgcccaggctggagtgcagtggcctgatctctgctcaatgcaaactccacttctcaggttcaagtcattctcccgcctcagcctcctgagtagctgggattacaggcacctgccatgacccccagctaatttttgtatttttagtagagatggggtttcaccacattggccaggctggtcttgaacgcctgacctcaggtgacctgcccaccttggcttcccaaagtgctggggttacaggtatgagccaccatgcctggccaggaaagaagtttcattggctcacagctcagcatggctggctgggctcaagcaatccttccatctcagcctccccaaatgttgggattacagatgggagccattgtacccggcccttccttccaatttaagctgaatatttctttggtcaaatcagtatgttgcttgtcagtacattcttgtcagtctcaatgggctgatgactgggcccatgacatcccccatgatcactgacagtattttaccgttcctgatactgcagttcctggtcctcccctttcctccatacaaatgttacattcagtactcccaatctagacagtcgttcatatgctagttcctttgagatcaaaattatgaactcagatttgaagcagagatgagcacataacaaaggtatttgcgctgttcacaacttcaaagtcgctggcgagaaaatcaagttgctactggacgtatgcattccttctcacgtgaatcttccttctgatgctgtgtgctgtttcctagctctgatcacattgaataaactatgaaagttgggacctaatctccaaaacgagaggacaatggttcctgcaggaaaacacattctcttgggagtcaccatagtatccagtgggtaaaagcactgtttcaaaaggaaaaatgctagaaaacactgaagtgttcaattaagaacattaattctttagtggttttctacctgtatgccaacactacagatatcctattatatatatatatatctcatgtatatcatatatgtgatatatatgaatatatgatatatataagatatatataaaatatgtattatatattataaagtatatatatcatatatatcatatatgtgatatatgtatacatatatctgtatgaatctaaaaactgtgtatataagtaactttgataacagtaaaactaaataaaattcctatcgaaatggatcccatcaattgatttcaccaccagttcctctgatttattaggattaagaccagatttagcagtttctctgttggctgtctcaaccttctaacagataaaacgtcgaataaggcaggttaagagcgtttccagaagtgtatctttgttttctgttttttttttttttgagacagtctctgtctcatatctgatacatatttgatatatatatacatatttttctttttgagacagagtcttgctctgttgtccaggctggagtgcagtggtgcgatcttggcccactgcaacctccacctcctggttcaactgatttttgtgcctcatcctcccaagtagctaagattacaggtgccccctaccacgcccagctaattttttgtattttcagtagagatggggtatcatcatgttgaccaggctgcatttgaactcttagccacaagtgatccgcctgcctcggcctcccaaagtgctgggattacaggtgtgagccactgcacccagccctatttaatattttgaaataatactttacatgaacagagacagaaggacaaagatatgcttgtaatggtacagaaaaccctactgaaattataaaaactggtatggtaaataacttcctagattttatattaattgaggctttgacatggtcccaaagtaaattgaactctgtaccccttagataacattttcagtgtacttctatgtgccagacactgacctaagcatcttacatataccatattatgtgacattcttattaactcatttggcagataaggaaaccaaggcccagaagggtaaagacatttgccttgggattgaaagttcacattagtaaagccaggacttgaacccagctgtcatcccaaagaccatgctctttatcactagagcagtggttttcaataaggagtggttttgccccatagagaacatttggcaatatctggagacattttcagtggccatgcctggggctaggagtgcatctggaatccagggtagtctctagaggggagatgtcagggataatgccaaacatactacaatgcacaggacaccctcacaaaaaaggatcatctgggctgagcacagtggctcatgcctgtaatcccagcactttgggaggccgaggcaggtggatcacctctgtcaggagtttgagatgagcctggccaacatggagaaaccctgtctctactaaaaatacaaaaattagccaggtgtggaggcgcttgcctgtagtcccagctactcaggaggctgaggtaggagaatcacttgaacctgggaggcagaggttgcagtgagccgagatcacaccactgcactctagcctgggtgacaaagtgaggatctgtctccaaaaacacccccaaaaaccaatcatctggcccccatgccaagagggtcaccctgcaccgtgctctgcttgtttttctttaagaaattctgaactaattgcccattatcctgtccacagcatctagagttgtagctggcacatagtaggctgttgtctcctaactattagcaaatggattatttttctgaaattattaaagcccctatatggctacataaaaagacaccaattgtttttctttcataagtgattatgtgcctaatactttaaaaaggcctatagacttgaacctcaccacaggtgcttggaacaggggccctgatgtgtaaaactccccagggatggtatacaagtcccacgaatagaccctaattacttaccttaagtgcagatatataagacatctaccaatttgtttccccacacaccagttgtcccacaggactttgttaagtatgcttatatgtacatcttagagttatacttttaacaaggtttagaagaaaacaatgcttactatacacttcttgggttttcttttccctttgttattccataatcatcaccctacctggaataaataggccagggccttagaggaatgtagcaattctgttgaagttatgggaaagtggctgaaggacctaaatggaagatggggagttagaaaatggaaagacacaatattccctgttagcctcccggcgggcatctttctccactcctttctagtttgtatgatgggaagaggcttatgcggaggagaggacagagaattaggtcacacccatgataactgaagattggcttatttatgaatatcttgcacggtgcaagtataccatgtaggctcaaactggagaaggctgtattttaccctcctaacctccttctgcagctttaatgaaagttttcaaaggggaattgacatgtttaattgttaactagaagactcatttattttttttcattcattcattcaacacatactaagtgtgttagtctgttttcacactgctatgaagaactgcctgagactgggtaatttataaaggaaagagatttaactgactcacagttctacaaggctggaaaggaaacttacaatcatggcagaaggcaaaggggaagcaagtacatcttatatggcagcaggagagagagagacagaagggggaagtgtgccagactcttatcaaacaaccagatcttgtgagaactccctcactatcaagagaacagcatgggggaaaccaccaccatgatccaatcacctcccaccaggtccctccctcgacatgtaggggttacaattaaagatgagagttgggtggggacacagggccaaaccatatcactaagcaccagggtatcctcctgagtacacagatggcctacatttcctaacctcatttgtggtgaggtgtggccatgtggatgagttcttaccagcacagatgagcctaagtgacgccaactacttctccgcccagaccttaacactgatcctgtaggtggtggcaatgccccctgcagtgtggaagcagcataaggaaataaacctaagcggctctcttgtgagcaagaaattcacttctttgcttatccagctgctctatttggggacatctttgtcatagcctttgttacttacatggatgtctaatagcagtctatgcactcatggagttcataatctagacagacagtaaataccaaagataatcagggaggcctctctgaggaggtgacatttatgatgagacctgaagagtaaggattatcagccatgcaaagatctgggcgctcaggcagacagcaaaacaaatgcaaaggcagaaattaacttgtgtctgaggaatagaagagtggcatgactggaaggcagtgatggggtcagagggtcactgggtgaggttgagaggaggcagaggaagagtaagtggaggcagttctaagtgtgatgtgaagccactagggtgttttaaagtgggtataggcatgggtgtgtagagagagagggagagaaggaaagagatagtatttgatttgcatactgaagatcacctttggcgatggcatagaaaacagactgcaaggatcaagaatagaaatgagaaaagcgaagacagaatggcagtggttcagtgagcagtgatggtggcttggaccaggctattagcagtggggatgtgggaaagggctggattcagggatgcgtttggagagaaagtcaatggatctgactgacagattggaagtggagggtgaaaaacagttcttatcttgagcaggtgggcagtggtggtatttgttaagctgggcaagactttggggggtcttggaaatgggggggacatcaagaggcctgttttgttttcgcttttgtttcttttggagatggagtctccctctgccacccaggctggagtgcaatggcgcaatcttggctcactgcaacctctgcctcccaggttcaagtgatccttctgcctcagcctcctgagtagctgggattacaggtgtcggccaccatgcccggctaatttttatatttttagtaaagatggggtttcaccacgctggccaggcttgacttgaactcctgccctcaggtgatccacccacctaggcctcccatagtgctgggattacaggcgtgagccactgcacccagccaagaggtctgttttaaaagtgctaagcttgagatgcctgttagaggttgacatggagagtcgggggttcaggagagattactgaggagtcttcggcaaatcaacagaatttaaagccacagacctagatgtgtcctcttagggaaagggaaatgggagaaaaagaggagaagaccagggaaaaagtgtctagcagacatttaggcatcttctcaccagtgtctaggataaacaacacatcagcatttctagggaagtggggaagagcccgcactgttggtaattccaactggcaccatgagaatttctgtgagtgctggtgccggcctgcactggctcatgatagctgtttgttaaattttcaggagttgtgtgagccagttattaaatacagctattattgtggaagtcagggtggagcatttataacacagaaaccagcaaattatccataggaggatctctaaaaatttttgagagcctatctgtaagcacaccactggtccccacataatttgtgtccagacttatcagagaaatggcatgggatccccagatgccatctgactcatttcttacataagccgacccataagcacatcatttgtagtagatgatggcatgatcccattgtctgggaactcctataacactgtgacctccatccactgttgctctcttgccagcacaagtacacttataagtggcagtggttttttttgttttgttttgtttttttgagatggagtctcactcagttgcccaggctggagtgcagtggcacaatctcagctcagtgcaacctctgcctcctgggttcaagcaattctcctgtctcagcctcccaagtagctgggactacaggcatgcaccaccatgccccccgctaattttttttttttttttgtatttttagtagaatcggggtttcgccatgttggccaggccagtctcgaactcctgacctcaggtgatccagttgtcttggcctcccaaagtgctaagattacaggcctgagccactgtgcccggctggcagtggatcttaagcagccctacaaaaatgttaaagggaagggatgggaacctgagtatctggatttttgtggaattaatttttagaaaggtagaatattctctatactaaacaatagtcacaaacgatatgggaacttggggagttcctttcctctgaggcatgggtggaaacactgaggtaaatactttgccccatgaaagaaagcagaggggactccggtttcctggatattcgagacatctctccaaccttggggacacgcagcaccccatgatagcaagtttgttttttataatccttctttttcctccactcagtcttggtattctctctaccacacctatttcattgactctaagatgcgttttcacaaaggtgcaaatgggttgatgagtttattcaggagtattgacatgctacggtgcactggagcatgcagccaatctccctgcacgcttgagtgggccgtggttacctccactgcctccaacaggaatcgagtgctgttttgtctccatgctgggggactggagagatgtgtcattccagcatcaccctaattatgattttcagaagatgtagctgtctggatataacagggccatcaaaagtgtgtggaaagagtgtgtgtgtggtgtgtggagtgtggtgtgtggtgtgtgtgtgtgtgtgtgtgtgtgtgtctagatagcagagggtacacccccagaggctgggcttaagaatgaaatggagttattgcattactgcctgtgcaaagctaagcctgcatgcacagtaacagacgtactgacataggtgctcacacgcatatgtacaaaacccacgagctatcctgagcgaggcttttctttagagatgaatttagtgaatcagagaatgtcaaatctgtaaaaaaaaaaaaaaaaatcaccaaggttatcccacccaaagctttgttgttgttgttgtttcagatgaggaaactgaggcccagagaggttaagtgattgccctgaagccacacagctaaccagagaagatataagttcctgccttccttacttcccattctcataagcaagtttccgcatgaacaaggtggcaggtctgagcaaaatgctaaaactgtggccccattttgtttgtgcacatgtatgtgtgtacatgagctattggtgtgacgggagtttgcggggatattctctccctgttacatgttttcacatttcccacaagacgggaatgaaaaggaaggaagagctgaaccattccctcaggcaagtagatctgtggcaaacaaagagtccacagctcggtctccacgggggtcagtctgacttccttccctcagaagcatcccgggctacattttcatcttcgccgtcttccaatcttgcataatctataataatgtgattccaaatgcattttagcaaatgcaagatggaatgggactcccccggctgctcccgaacatctgatctaagaaacccgtaaggagctgcagtgaaaagttcactgatagaaaaaaacaaacaaacaaacagacatttgcctgtgtccctggttaggggcaaggcttttccgggttggtggctcttggtcatctttgttgtccttaaaaaagggataacgctgaggagctggcggttcacctttgctcttgtgtttaattgctgcaaaagccacttattaccttgtgttcttccgcagagggcacactgtctttcccagccaccaggcctgctggtgtttggcttctctacctgccccggaagccatccccgtcacctccgagtaattctgggtcacttccagggccaggtctgtctggctccggtacaggaaggccctcatgaaaggaagaagggcggaactgggatttttttttctttctttgaattttgcataaaattccgtccccagccacctaatgagaaaacatccatcatctatctttccctgggaatgtcggtggccattctgagctggtttgtggtcccgctcatctgtacgcaggcagggcttgtgaaattgcttttccctcagaaaaatatgttcatttccaccttcctcagatggccctcacaaatgaaagtgctttgtcatttttaatgcccagtgttccctttttcccgcactgtctccagtcacgatccagccgataaaacccacaggtacatttaaaacaaaaaacaaaaaacaaaacacacacacacacacacacacacacacacacacacctcaaaagcccagaggactgtcagattccactggtgtccccttgtgggttttcctggcacacagagcaaaaatggctgcaaggggaggttctctctctgttccctggaaatctccttgggccttgtgcagcatttggatggacacgcagcgacaggggacgtgctgaattctagataacagatgcctgccttaaaatggaggcacaaagcccagccctgtccccttggctggccggctctgagcatcctgagaattaacagaggtacatgtgctttataaaaactggaaagtgtactaaaaattcaaagttattattatttctaaaatgtctccagcctacgatttgtcataaacacctatcattctgcatagataattgggtaattgttcctcatgccagagggaacaaacgtctctctttgaaatgtgtgtggaggcttacacatagagagccctgttataacgagggtctgactccatagagatttgtagatgccaaaagactaacaataacctcctccaaaaaataactgcatccagcttttcataggcaagttagtaggaccacctgattccagcattttaaaagagtcaccctctatatggaaatgtggtcaaaatactagtccaggaaaggaacatgacagatttgttggccaaaacttatttcaaagcagaatctttgtaaaatatgatttttttcccacatatctgcatttcaagactgggttatctttgtttctttgtgattgttatttaaatacatattagttttaacttttcctaccttttcttgatcacaccatccgctgagttaaggatctgtaaacaaagcttgaattgagccaaaatgatctaacttccaaagggaacccttgtttcctcaggtaaacttgaacgtcttcattgatgatagagaaccttgcttctcaaataacctagcatgaagggcaacttggtagttgtttttgttgctaatatccaattccccatggcctgatacttttgtaaaatacataacagttgaattactagaaaaataaaatgtcgcttgaatgttgcagtcatgtcatatggctacaaaagtctttaaactcttaactctgaatttctctacttaacttgttgagaatccctgtcaaatggttaacagaccaggaacgacctgtggacccgctttgagtagcactgaggttgagacagctgtcctgccatcttacccacggtggctcattttccagctatgaaactgctcactccttaacttataagagtttgtcaatccaatgttttaataccttttttaaagcagggacaggtctgtatacaaagcctgcaagctaagtaatcagttgataactgagagggagggctgttaatgtcaatatgagttacacaaagcattgtccaagaataaatcaggaagttaccctaaggtacggcagagggaggggagggcttgggggtggctgtcgtacatatggaaaataaaaaaaaaaacattacagagaagtaattcttaacctgtattccataagacagtagattaagaggtaatagagagagctaacaccaggctggactaaagaactggaagcagagaacatacacaacagtgtaaataggcacacacacgtgtgtgcatgtgtacacgtgtgcatgtgtgtgcatgtgtgtgcacgtgtgggcgcacggtccacctggtgggctggctgattggaactgagtaaggaagggtggaaaaaaggttgagggagcattttcagaaagggggtccaatttatatccgttgcagtaattggtttgtttgtgtggagcaggaagaaggggcagtgggggacgtgatggagtgaaacaccgagggctgcgattcccctgcttgatgagttggagagaaattgttagtaaccaagactggtcccgcaggggttcgttaagtgactggccctccaccatatcctgtcatttccaacctggatgcatcaacattagcccgctttgcggtatgcaattgtgcatctgcacgggtgtgtgaaggcgcaggagcgtctgcgggccgggtctgtgtgcacgtttgtaccttttcttgtggatacagttaagttttccatgggaattagaatcatgaaggccacatgcaatttttttttaaaggcaaaaagcaaaaggtgctttcttactggaaacacaaatttgctgtgacacttcaaaagtaccgtggagttgaacaataggaaaactaagaaagggtctgaactgggcgggctggagggagctgagcactgaaaggctggccggtggcgaacacatccaaatggtaacttcttaagtcagccctgaaagggacagtgagcagtgtttgtctccggattgtgaggcctgtcaacccctgggagacaggggcccagaaactggagttcaggccaagagccaggaaggaaggatcggcaaatttgccaaatgtgcagactgcccacaatgtctgggtgctggtggcatttggagtcacggatgctctgtctttggatcttgggattttttttttccaggcgaaaatggaagaaagactcctgtggggaattttaagggtaggagtccctttgggaaccccataaattcagatcttagaaaagcactgaggaaaaaaaccaaaaatgctttttgcaccagtgggaactctgaggattcagtctcctaagtgctctgcctgtctgggttagccaaggatccagtttcaggggctgggggaaagctaatgccatctaaaggaggccagcccctcccaccccctcaacccacttagctcagtcctggacaaggctggactgtagcctctggacagaggatccccttaaggcacagaagagggctggacttcaacctctattctgtggtttgtaatggtttcctggaatgaacaatcaaaatgtaaaacctgcaagacatgaaagtgaccatctttgagtgctttttctacttcctaaaacagggatgcactctatctgcgcagaggaaaactcgtaggacctcctaggatgcatcttggctccaagttcgtgcagtgttattaggaaattacaagtctaagcagccgcaaagagaccgttaaatcacatcacctgcaggtttgcaaatatatgaagataggcagagctaattgccattattgttgttggtatcattattgttaatagatgccatctgttgatacttcacatcttatacatgtctcattttcatcttcattataagcatgtaacagaaaaaggcaagtactattattatccccgttttacgcataaggacaccaagtctctgagttcaggatgtccccgcgagcccagaccacctgagtccacagccatgctcttagcagcttgttttgctacccctccaagtcctgttaccatttcctaagtgtttcccaggtggaaggcccattcgaagcactttacatacattatctaattatctcatttggtcctcagagccacaaatcaagctaagcagactgcccaacctccaagcacttatgagcttgttgttcccacggagtcacatcatccttagaccatttgcaacggtccaaggtggcagagaaatcacttctgggcatgaatgtggtcattaccaatggccgtgatgggacctggggctgttgctcttcaaggctgatatgagcctctagataactcaggaaggaaacttttaatcctcatcattacaaccatcagtgttgttctgagcatcagcgaccaaagccggaaaggaaataaagaaggactttgagagtcatgtgtgttttgcaatgaaccaaaggcaaatggggctttcctgaattttttaaatttaggggccagaatggaaattattctgtttttttccacatctaccaagaaggactaaggcttagctgtactactttctacgatcctggctgatttttctttttcagtagaataacataaaaaaggaaggccagggtgctctccaaacagaacccagatctaatgaggggattttggagttgtttatatagcatgtctccttatctgtataaagcaaagaacatctccaggtattttcagtggattgatctcatcaagacacagatttattaaaaagaaacacagatagagggaaacaggccactgtaatttatacattagtttttttgttttttgttttttttttttaagaaataaaaactaactccaagttttttagtcattgcaatggggccctgcacatcacgtatgtaatgtaatgacagcttcagactagggatgcttttgatgcattattaaccataaaaaagacattaaataccaggctggaatgccatggggatgcatatttcactaggaattatttttcaatgtatgcttaaagtttattttggtaaacagatgactggaggctgtcagagccggagtaagatttatgttcatttggaatcttcttgaaaggagcggaaatgcctgggacttgtggaacacccacagcaaaatgtaaatcttttcttggccccagggaaggttggagagtgccacacaaacaattcctcctagggatgtgtggtttccaagcagcatcagcgtagatgcccgtaggggcacacgccgggtagagggaacacacattctatcgtctctaggaggagggagcagaacaaaaacatctggactgggaagccggcctcaggatgccccatcagatgcctgcgcatcagctgcaaagaacgccccgaactaattcctccgtttcacagtcacccccatgttggcaccaggagctgtttccttctgtgctgacacatttgtaaagcatttctggttgtggacgtagaacttattgaccatgtgggttttcctatcctttgtaaatgatggaggcatcactgcatccatctacaaagcccttccttggagcttctacagccccaggaaccgtcacagagttacagtcgaggcaggaccaatgggtacctttctgaaactgaagacaatttcagatgatcacagtgtgcacctttagggcctgcttctgcttctttactatttgatacttagtaagtttcatcctaaagacatacccattttggcagatactgacagcttcgcgtagctgctccaggctcaacaattcgtatggaatgctataaattctgtttaacatttgttacatagatacttagctacagattcagagccagatgggcacacctaacccatatgcatctgtaaaatactctcctgcccaaatcctgcctgtatctggaacactctgagtgctcagaagatgttactacaattttagggccgaaggatggtctatttcaggtcaatgatctgtgatttgcactaacagggtattagtggcatgaagatgtctgcaaaagaacagaaagaaagagttgggaatgtattttctttttgcagccttatcatcttgagctttggctggggctggtttatattatctggcgacattcccatttttaaatatggcactgaattagcctaggcactcatgtttcagtttcttagagtaacaattaattgaatcaaggttttggtgatgccctcctccaagggtggctgattctgtagcagcagttctcaaaagaaagggtgattttttcctgcagggcgtatttggcaatgtttacatatatttttggttgttacaacttgggagtgctagagatactcagtgggtggaggccaaggatgctgctaaacattctacactgcacaggacctccctacctccagccaccacggagaatgatccagcctcaaatgccagtcgtgcagaggttagaagccttgttctaagggactgtaaatgcggccgctatgctttgtgactaaaagtagctggaatgacagttcggctgtgtacaatccaaaaccgattgcattggaaaatgagggaagggcctgaatgctggttttccactgaatggtggttcaccccttgggtcctttgttccatggcctgtggtatgatatcatcaatgctctgagacccacacagcttggcagaggacacatcagtagtccaagaaggtgtcactgtgctcattccatggttggagaaatggaggtacagtacagttcaatgacttgcaagagaccacagcatgagggagtggcagggtcaggaacagaccactgagctttccacctttagtctcccacctcctaggctggtgttagaaccaggagatcacactgaacacacacactcgctccctcccttcctctcctgcatatagagatatagcaaatgcaggttaagttgactttaatctttaattcatacacaaggatgtgcagcacagagtgaaataaagagtaaactccagaggcagcaagttctgtaggtttggccagatcttccttttcaaagacagacagcctggggaatcgtgcaaatggtcttccactgccctcttagattctttttatggcaaaatgctggcttttatcaattcctaccccaacctctgattcctacaggctggggaaagcaaacagcagttggggaagtgcatccaccttctcttgtgatggcaacaggagacttggacccctggggaggccaagaggaggggagtgaaaaggggtgagctgcaggagtggatgggggtgggtgggggaagaagctctggttgcagatacctgtgaaacttgtttttttttttttgcttgggtggagggatttggcctgggacccaaacagatggttgttcattctgaccccctaataggcatttctgcattaaatgatatcagagtggacacaggagaaagaaaagtctattgttgtgtccaccataaaaatagacgtgtggatgaaatgatcttggagcagaatcgactagagagggtgaacttgggcagaagaaatcaactcggacaagccagagtccctgacaaggtcgtgaggtctcaagccaatgggatgacataaaaaggtatttggatgccaataactgtaaccagcagcagatgcagctgctactggttcctcattgacacgtccacccttccttttcatccccagtgcagtccagccaagaaataaaggcaacttggaatcccaacagctggaagtgctgcagttccatatgtgtcaattgtctggaagcctctgggctgggaatacttactcctttgggaatgagaggaacacgagcagagcggggctttggaaatccgttcccagctagctgaacttggggccctctaggcttgaagtcaggacagcggtggcctggacatttccagggagtggcccacagggttgggtcattggccagatgctgctgtgtgccagggtctgagcccttgctcagaaaagagacaggcatggctttgcatggaactcaggtgtttggtcctctcccatgggagaggaccacaagcggcatcaaattccagcgaggcaaccgaagttgtcctcatcttccagacctgctcaaactttatagacatgaacgccaaagattatcccaccccgccaaaaaaaatgttggctctctccccattcatttcaggatggccttgtgcaagggactcccactgttagtttaaacacttcgttctctgcattcaatccagggattcattcatttggtcaaggtcagccacagtaaagtagaagtgttaacttatctgctatattagcattcacccaaatgagcagcttacttgctaccaagccaactattaataccttttggtttatagcaccaaggtacagcattgcagagaataagccaggagaaaatgtcctgacctttaaaagcttagggttccctggagaccccagtgacatatctcagcaaggagaagagatatcctggctgagtcctcaaccctgggtgtggccaaagacaagaaaatatggtttcatttggtctggggacagccatgccttggatacatggtaagaaatcttgactcctggaacatgcttgcacctttccttttaagaactgttttcatgccccagttataacagcttttatccaaaagacaggcaataacaaatgctggcaaggatgtggagaaaaggaaacattgcataccactggtgggaatgtaaattagtacaaccactatggagaacagtttggaggttcttcaaaacgcgaaaaatagagctaccatatggtccagcaatcccactgctgggtataatccccaagaagggaaattagtatatcaaagaaatatctgtactctcatgtttattgcagcactgttcacaacagccaagatttggaagtgacctaagggtacatgacgaatggataaagaaaatgttgtacataacacaatggagtactattcaaccataaaaagaatgagatcctataatttgcagcaacatagatggaactgaaggacattatgtcaagtgaaatagccaggaacagaaagacaaacttcacatgttctcacctacttgtgggagctaaaaatgaacaacaattgaactcacggagataaagaaagagagtaggttgatggttaccagaggctgggaagggtagtgggtggggcaggggggtgggtgcaggtgggaagtggggatggttaatggctacaaaaatgtagttagatagaataaataagatctagtatttgacagcaccataaggtgactaaagtcaacaataatttattgtacattcaaaaataactgcaagaggcaggcatggtggctcacacctgtaatcccagcactttgggaggcccaggtgggtggatcacctgaggtcaggagtttgagaccagtctgaccaacatggtgaaaccccatctctactaaaaatacaaaaattagctaggcgtggtagcagctgcctgtaatgccagctactcaggaggctgaggcaggagaatcacttgaacccgggaggcagaggttgcagtgagccaagatcgcaccattgcactccagcctgggcaacacagagagactctgtctcaaaacaaaacaaatcaaaacaaaacaaaactacaagagtacgattgaattgtttgtaatacaaagaaaggctaaatgcatgaggtgatgggtaccccatttaccctgatgtggttattatgcattgtatgcctgtataaaagtgtcttatgtaccccaaaaatatatatataactactgtgtatccacaattaagaaaaaagtcttcagtttgtagccacagcccagatgagtgctgtcccatctcctgctcttggaccagtgtgatctgaaaggatgacatccagtagatggaggaaggacccaacaagagaggctgcatcctctgatgatactaatggtattcctaagaatgaagaatcacagcttttactatctactaagtataaaacatgtgtgttacacacacaagcatgattccatctccttcccgtaacaacccatgggtgatgggaaactaaagcacacagactcaaagtaacttgcccaggttcacagtggcaggtgcagaactacagcccagcaccgaataatcaaaatgccaggctataaatatccagttgtcatcccaccgacatagcacagagctctgatacataagatggatatgggttgctctcctagagctgccgatggcattgagcacttctgaatatgtcacggatggccaccaactggacagctttcatgctgctggaattttaaagacagggccctgtgacagagaatccgaagagactgggaacaaccacaagctagagttgacttcagaaatgctgatgtgaatttccgactttagaacctcagtccttggccaaaaatgtcctcaattttttgacttcttgtacagtgggatttaaagagattagcaattaaattttataggagatttgtgtattattgttaaaatttcatcagaaattggcacctgccctttgaaatatgcacataaactattccctgaagtatgatttttcaagagtgttgttgaacaaaaatctttatctgtgggaatacctttctgaaattttaatggccatcaaatgggaatatatgattctctccacaaaaattccatttatacttctttgttttttttcaggatcacattaagtgaaatatgaccatatacagcaaagatgtcatgggtaggacccataagtgtatctgtatgcctgtgagggtgttggggtataagtttaccttgttttaaaattttaaaattaactatcagcatataaaatccaggagatagtacataaaaattcagatcgatggcttctcttgaaaacatggaatattttgaaccctgggtggacatgtgactgaagcttagtgcaagctggtcctttttatgggacatgtaccctgcaggttactgccacgcccagcatccttactcctgttgtgtttcatgaatttctatggcctgcctgtctccttagacatttgagtgtgtgacctccagtctacatgatagcaggtgcctccatgtgtggaaataagtctttcttggttcctttgttgatgtatttagtttctattggggctaaaacttaaggaagagcaattaaagacctctaagacagataggcagtcttccaaagactttccaataaaaataaatatcagccaggatctgtggcttatgtctgtaatcccagcacttgggagagcgaggcaggtggatcacttgagcccaggagtttgagaccagcctgggtaacaagatgaaacccagtctttacaaaaaatgcaaaaattagccggacatagtggcgcacacctgtaatcccagctacctcaggaggctgagaagggaggatcatctgagcctgggaggtcaaggctacagtgagccataatcacgccacggcactccaccctgggcaacagagtgagagactgtttcaaaaaaaaaaaaaaaaaaaaaaagtaaatgtcagagaatgtgtttgtctcctgaagtccctgcactagtgcacactgtacccattccacctgaattgccatggcagaccagacccttgctcagtttgtcatggccatgttctttgtgcttccctcattcttgcttacagtagacaactccctcccctcccctccccttcctttccctccatcatccaccttatcctcttccatcccggcctcatactttgcctcagggcaaggtctgtagtgttaagactgccgatggcctgagagaagaggccgatgaacccctggggctgctattagtatcggactttagacacattacaagttaaataggcttttgtgggctggcgggagatacaaccaccatgcgtgatactgtttctgggggagtatttcacccaggttccgaacaacagacttaaaatgaacttctgcaacatcatagcctattagtacattggattcttccaaattctagaagataattgggctttcttatttgcaacgtgttttcttagggcaagatctatatctgtctctctgtgctacgctgttgaagagcaataatacagatgcatttatggatcttaacaggagcgatcaactcaccaactatagctaagggcccaccgtgtgcaaagtactgggggaaaaatgtatagaaagctgccttgcaggagttcacaatacagtgtgcgtgttgggcacgaaggtggaaatggggcaaatagatggattactggcgattatgaatgatatcagagaaggccacagagattcagaaaatagcaggactagagacattcttatgaagaagatggtttggaatgaaagtgaaaaaataggtaatagttcaagaggcccttgccatcaatgacgtgggattccccaggcattccagacacagaacagagcaaagaacagcacaggagtgagaaagttcaaaggaaacttgggaaacagaggggaggctggtttgggtgaaatgtgacctgtacataagggagtgaaggaggatgaggctggaagagtgagttgggactgtgttggagagggctctgggcaccttgcggaaggactgccatgtaattgaccccaagacatagcaggcctgcgtgtggacagattggagggcagtgagaccagatgtggaaacagcacttagaagctcctacaattagcaaaaggcaatcagtagctctatgctgggggctggggtggaggagagaggcaatcgaagtgagaacattgtggttttggggaaatctcaagaactctcccagatcttggtgctgatgatgtcatttatctaacaatattattctgatacagtcactaaaccatccatccatctatccatccactgaacaagtatttgcatacctaggggcattgttcatgttatgcatttgatttggaaatttttctacacgtatgtaatgagttcaaggtcaaagactggagaaaccaaatgttctaagatgatttgcccaagtaaaaatgctctgcatattataaacaatgtttctcaaattgtgatcattggattattagaatgaaggatactttaagaaaacaaagattcaatattcaaagtttttatgcctcccttggtaaatcccaacacccatacaaatgatcaaaggccctgacaagtcctgcagttaaaaacaaaagtaaacaaaaaaactgtttaacctttcgcagttcacactttgaccacaggactcttttactgaataatatctactaaccttccaagaaacacattatgaaaaatattgttacaaagtagtatataaacttaaggcatagaccttcaagtgtagttactccttttaggttacctctagctccaaccattacctgaaaggtaaatgaaagggaccataattcagggtataacccacacagagataatttctaccttttaaccatttattgctgcatcacagattatcgaccacctactatgtgccaggcactatgtatggaattcacagtacagcagtcactaagagatgtttgtccctgtctgtaaagaactaaacttacagtttaatcagtaacaccaaatcttcactacaaggtgggacaaattggccactcgttctcctaccctcactttccctgtgattctccaacttatatttaccaaagcagttttattacagtgatatttcaaaagttctttatttaaaaagggtaattaagaggtaggatcccactgggggaaatgagaggccaagatgagagaattgcttgagcccagaagtttgagaccagcctgagcaacatagggagacccccatctctacaaaaatttaaaataatccaccaggcatgggggcacgtgcctatggtcccagctgcttgtgaggctgaggtgggaagaacttgagcctgggaggttgaggctgcagtgagctgtgattgcgccaccgcactttagactgggtgatagagtgagatcccgtctgaaacaaaacaaaacaaaacaagaggctggatcccaaaccagtacattcctctattagccagcagaggtgagaacagactagctaggaaaggagtttcacaagaactggctcgaataaccccagctggggacaaattttgattttcctcatctctggattcttctctctctttaacaaagaccactacccatgatcaattcctgggtgtctagcccaatccagcattcacagttcattcctgggagccaaagttcccttttgtagttccaaatgtttctctctcagttttttattttatttttttaaaataatgaccgatgttctaaaatcagctagcaagataggcaaaataatcagtaatttctaattgtatatttaaaatatcaatacgaagtggttctgggctgcaaaccagaagaaacagacttggcttataagacattaagaaaatttttagtcttgaggtctgcatgttttgtgagctttatatagaggataaaagtgaaacttcagcttttaagccatgctgttaaaaattatatttacatccagtataattctgcaaccattaagccttaaatgggtattaagcctgattcaaagtaatgaaacagatggtggaaacacacactatggattcttcaatctggggagaaaagggctgattcatctgtttcaagggccaggcaaagataaaagacttcatcccaaatggagctgcttcctcctcaaaccttagcattccctccaatgtatttctccgtgtggaaagtattattaatgtcagtatccccagtgcttgtaaaagattcataggccatttcctccccttactgaattcccctgtctgtcccgtcaccgccccatgttcgttcatctcactgttgggcagtttggtgacgccagttgcagattccatcacaacccagctgcctgtcataggatcacagcattttagagctggaaggggcttagagatggcattttcagaagagaaaatggggctgggcacagtggctcatgcctgtaatcccagcactttgggaggccaaggttggtggatcacctgaggtcaggagttcaagactagcctggccaacatggtgaaaccccatctctactaaaaatacaaaaattagctgagtgaggtgatgggcacctgtaatcccagctactcgggaggctggggcaggagaatcgcttgaacccgggaggtggaggttgtgctgagccgagagataatgccattgcactccagcctggacaacaagagcaagactccatctcaaaaaaaaaaaaaaaacaaaaaacggaaaacaaacaaacaaaaaacagagagaaaacagaagctcaaaggacagtgacttgttcaaagtcacacagtgagcacagactgggatcactgtaggcatttttattcctttgcttgtcttctttctcctcttctttcccacttctgaaaatatttacagaatcctttatagggaccagggtgggaaattaggagaaattctacaaggtgagaataaaaatgttgtagacagtcagcccaaaggttgtgggagtgctgatgaataaaggtagatggaatgggaggactagaaaaccagtattggactcattcattatgaaaattaatttctaactttagggggaacatggaaaagtccctgtgaggataccacagtcataaatgtcgtaggcaagaccggtgctgccaggggtactcaatttagcagacgaaagttgagaagtcggccggacgcggtggctcacgcctgtaatcccagcactttgggaggccgaggcgggtggaccacgaggtcaggagatcgagaccatcctggctaacatggtgaaacccccgtctctactaaaaatacaaaaaattagccgggtgcggtggcgggcgcctgtagtcccagctaccagggaggctgaagcaggagaatggcgtgaactcgggaggcggagcctgcagtgagccgagatcgcgccactgcactccagcctgggcgacagagcgagactccgtctcaaacagaaaaaaaagcaagttgaggagtaggatattatcatcatctcaacgtacctcccaaaatatacttaacagtttcaaagggaaaaacagtaactttgcggcatgaaaacctggcagataccaccttacccaagtgaccaaagggactatcagttataagccaaactgacatcacgcaccccgcatataataccctgagaagggcacgtcacctctgctattgctgcccaaaacatacgcatgtcttcgatcaaatcatgagaaccttcctatacattctatccagtcatggagcaatactttttcaagtgtccaggtgtgaaaaacaagggaggactgagaggctgtcatagattaagggagctgaaggaaacacagctaaaagctgtcttacatttaggattgtggataggatccaagaaacaggacgtgagtgaaaacaccggtgaaatccaaatacaatctatactttggtattagtattgtacccattaattaagaaaaggaattttttcttttcttttttttttttttttttggagacagggtcttgctatgtcgcccagtttgtcttcaaactcctgggctcaagtgatcctcctgcctcagcctcctgagtacctaggattccaagtatgcaccaccatgcccagccgatttcctaattttgatagttgcaccacagttatctaggatttttatcattggggaagttgggtgaggaatacacagaaactctctgaacaatttttgcaaattttttgttgtctaaaataatttaaaaataattttttaaaaaggaaaaagaggctgggtgcggtggctcacgcctgtaatcccagtactagtactttgggaggctgaagcgggtggatcacgaggttgggatatcgagaccatcctggctaacacagtgaaaccccgtctctataaaaaataaaaaataaataaaaaaataaaaaattagccgggcatggtggcaggcgcctgtagtcccagctcctcgggaggctgaggcatgagaatggcgtgaacccaggaggcggagcttgcagtgagctgagatcgcgccactgcactccagcctgggcaacagagcgagactccatctcaaaaaaaaaaaaaaaaaaaaaaaaggaaaaagaaaaggctgtgggatgcaaggaaagacagtaagtcatgggatggagctataaagcacagcagctgaccattccttctagaaccttctaaatcctaaaagatggacagaggccactgggaactcgctatttcccttttgggttaatcagaacttgtacgttattatagccataacattcacaagttagataaacttctgagaataagccccagggcgtggaagggattaaggaagagtccgatttcctcatcagttgcagctggtagacggtggtaccaggacttctgttgagtgactttggggcagccgccctacaggctcaactcccagaagctacctggcccgatcacctggaatagggagtccccctgtcacgggaaaggatgagaagtgggtacccagggaaggagtggtggggggaagaggacatctttgttcaggctgtgtttgttctacatagtgtgtatatgtttctgacaatgaaatgtgttcttggaaatgtccccttcatttatagatgtatcactgcagagtatgtgtgagaaaaagaaagagacatgtcagaatcccacagacaacagcttagccctgccttccattatatatacaaagtgttgtgtacgttagtgatacatttgcagaaggggtgggaatgtggctttgtccgtatttccaaatgtaaaacaggtctcccatcccctctgtttggttgtggctgtttccttacagaatgaaaatactggcattggaggcactgttgccagaaacttgcttggcaaaacatttacattcctttgtacatatatataaacaaaatcacttcttccaatggatactttttcacgtcctccctgatttctgtggtaataatgaccacatttggctccaaacctggggatgtggtagagaaagccacctcccaattccagatcctgaaatctcgtggaagattaacatggacgtcaaactgacgttaccaatttaagggatttaaacactcagctctagagtaaacaaaatccagtggcaaggttttggacaacttcagcgacgtttgacaacacaacccagatgttggggagtgcaaaccttgtaaacgtaggctttccactgtgttctgtacaagcaagatgttgagtgagacagaccggctaatgaaggaaagaagtactgataattattgagtgacttttatggggcagatagtatgctaagtgcgccatagacactgtctcactcaccatttgcaatgaggtagctattatttattgatatggacatgaggctcagaaatctgcaatttgcctcacttggcaagtgacaacatcagtatttgactcatgtgagtgtgactttaaaacctttgctatttccagaagtcaacactgactgtatgtaacattcctttgcttaaaacctcccagtttctctcactgccactagatcagtgactgtctcagctcagcctttgatgccttggtggtggcccctgctgccccacagaactaaaagctatttacgtaaggctggggctctcttaaaaatgtggttccctcagtcttcccacctttgctagcatttactatatgccatatgattttttttttgagatggggtctcgctatgttgcccaggctggacttgaactgctgagctcaagccatcctcccacctgcctcagcctctcaaatagctgggatcataggtgcgcccctccgtgcccagctttggctatgtgatttcttcattcacaagtctgcctgggactccttgtccataagggtgttgatactttttgaatctaatgatactatgtgcttagtggttaatacctgcttcttgctgagtgaatgaatgagaattaacatatatatatatagatagataatttttttttttttctggagacagggtctcactctgtcacccaggctggagtccagaggcgtgatcacagatcactgaagtctcgacctcctgagctcaagtaatcctcccacctcagtcttccaagtacctgggactaaaggcatgcaccactactcctggctaattttttgtactttttctagggacagcgtttcactatgttgtccaggcttgtttcaaactcctgggctcaagccatcagcctgcctcaacctcctaaagtgctgacattacaggcatgagccactgtgcccagccaggaaatgtttcaaatacttgaggtaataaatatttttaaattttatataagattctgtgtaagtgctatgaatgttacaactcattgtgaataatttactaaagcagaattcctaaagattcatattagatagtatctaatggttttatttcagtggttctgagctggggttattttgacacccctgcccaggggacatctggcaacgtcttgagacatgtgggttatcaccactgcagggaaggcggcgtcgctggcattatcgggtagatgccagggattctgctaagcatcctacaatgccctagaaactccctccaatgccagtcctcccaaacaaagcgcatattgccaagacggaataaccctgctttgtttgatgtaatgacatggcatatacttgaaggcagtcaaactacggttcatttgtttttttgttttatttcagatttttgatgaaccaagctggctggtgtcgcctcagtttgtctaaattaccaaggaccgctggaatttccctgggaatatgtttcgggaaaggtcagaaactcttcagtcgtcttcacgcttccactcagtagcaacgtttttgcacactcattgactatcaactggttgtctatgactcaaattacataatgaatccagcacataaattatttactcagatttaatgccagcaactgttatctttgtatttttttcccctctgccagctaatctggctcatttcattggaattttggtcatgcccattctccttctgcactaaattaactccataacgtagtataaacagaacaagcttgtgtgtgatatgcttaactgttaatttacctaattaaactaattcaattaaatcatttacatctttttggtaacatgccagttgataccacagcagaagtgggatgtttcagaagatgattgttcagcaaatgaatggaaaaaaaaataaaaggaaaacaaaatgagacaaccgtccaaatctcttggcttgaaaattaaatgatactgaaaaaatgcagctttcacggggcactgtgattagatatttttctgaaatcaattttctctacaaattggtattttaacagagtgatcacaatctattgtacaaaatattttaaacactatttgtacattcacatatttggtatgtttaagtaaagtgtgcttgttcccacattaaggtgtgatttgtgaaatgttttgtgatgctaacaagacgtgaactgagcagattcttttgaatgaatttgcaaaataattttgctaaattacataaatatctttaggatacatccgtatttcatttatagtcatcgtctaaacatccataccatagtgataaatgtacaaaatgtacaacattttatgccagtaaaaatcaacagaaaaaaaagacaagaaattctaggcaggagaacctaaactgtcatctttgtggagctccataaacctcctgtttcatttgactgatacagaatctgcacttgtggcagaacctaggtttgttgatggatgggccaccctagtttcatctctccagggcttctgtctgggtgggggatgggtttgttggtcaggatttggttttctcttcaggagcacacatgcccaggacaaaacttgaggcaaagccctgccttgacttataatgagggaataaagccctagattgcatagaacttcagaaaagcctacatgaaacccacctagattcctccatctgagcaaaggcctacaagattccaggacaaatcacaacatacaataagacctggcacctgcttggagcttcctcatgcaaaaggtacatttcctctaccacgcttccggggcaaacaggcagcacaggttatcttctggatgttcttgctttctacctatttctactttaaatccaagcatctttttcttttcttctcccatttaagaagcccaagaagataattcatggaaataaaacaggatgttttcagaagatttttttttttttttctatttgggaggccacctctgcagatactttcctctgctcaacccttgaatggggtcatctgtctttacaaatcaatggctccagcatatcctaaacatcctgacaacagagctttggaggttggcaataaaatgtctgaaactaatcttcctcccaccactcatgctaaacttattcttttttagtaataccaattccctgaagtcaggggccaccctgtctatccatttcacagcccaagcacagtgactggcacacagaaaatgcataaattattgatttcatagttaacaaagaataaagagacttttccccaaatcaaagtcatttttctccccaaagcaactttcccttccaacttcccagaggtcagtggcctcatgacttcttagcacccagacttaggtctagatttactgcccaaagggtcaaatttccaaaggcattcacatttcctctcaaatactcatgtgcctccttcctctgcctctttgctctattccttcctcttaataattgcagtcatcctcccaactccctctaccacctatgtcattcccaatctccattgaatactatggatttgaaggaaactgtgaaacagacaatcctcctgggttagtttgcttgggcttccataacaaaatagctcaggctgtagaaattcattttctctgtgagaaagaaggctacaggttctgggagggtagacatctgagatcaaggtgttggcagggttggtttttcctggggcctctctccttggctgtcttctcattgtgtcttcaaatggtcttccctctgagtcctaatctccccttctttcttataagaatcccagtcaaattggatcaggccttaccattctaacttaattacctcttcaaagactccatccccaaatccagtcccattctgagatactgagggttaggacttcaacatatgattttttgcaggggctggggagggacaaaattcatcctataacaccaccctttgttattcaagagctgttagggaaaaaaaaatcagaattccttcaattttgctgagcattggacagacacagttttatagctagacgactaacatttcctcttttgctctcagagagtgttggagtcttggctgcagctgacaaaggtaactgttgcctcaactcccagttccccttcatccttttttgacttgccctagggtcttatcctccacattccaccacactgggtgctggtgagaccgggcagactgtgatctcatgcatttgtcagtgatgcgtttaggtctggtcatttgtcccaatggaaggaaagcctgctgaaggattctggggaaaagtttgctgttaagaggtttagaaattggctgggcacagtggctcatgcttgtaatcccagcactttgggaggccgaggcaggtagatcacctaaggtcaggagtttgagagcagcctggccagcatggcacaatcctgtctctactaagaatacaaaacttagccaggcgcagtggtgcacacctgtaattccagctactcagtgggctgaggcaggagaatcgcttgaacctgggaggtggaggttgcagtgagctgagatcacaccactgcactctagcttgtgagacagggtgagactccatctcaaaaaaaaaaaaaaaaagtgagagagatctagaaattgatgcttcctttgtatctctggacaatattgggtctctgtgagatgttaatttctgtgccaatattaccattcaaaggggacctgaaagaagggccagctaacacatcaaggagagcactatccggaagaaatggaaaaatttcttggtgacatcaatgagccactgaatccacccatctgagagcccaccctaccactacatttgttgtttggtgagacaaaactgtttcatattatttaagccactttgaaacagattcttactactttcaccccgaaagcatactgaccaatagaaaggcttcagaccacttactagtagtctctcactagtcatgcttcctgactcatttgtaaaacagaggtaatgatacttactctgtggcatcactgtgtaacttgagtgaaatctgtcatgcaaggtgcccaactcagtgcctcataaggagaaagtgtctgaaacacagaggccatttctagcttttgctcttccaggggcttctggtagcttgaacatggctcaccttgcaccttctgcatatgtactcacaagcagagcaactcaacaatctgggctactgatggttttgttcacagtacttcgggaggcccaggtgggaggttcacttgagtccaggagctcgagactggcctgggcaacgtagcaagaccctgtctctacaaaaaatgaaaaattggtgaggcatggtgaggcatggtggtccatgcttatagtctcagccgcttgggaggctgagatgggaggagcacttgagcccaggaggttgaggctgcagtgagctatgattgcgccactgcacttgagtctgggagacagagtgataccctgtgtcaaaaaaaaaaaaaaaaaaaaaaaagagaaagaaaagaaaaaaaagaactagtatgaactactgacttaaaagtaatcaccatctttcaccatctttttttgtttgtttgtttaaagcaaaagagttcgttattctatagaaatctccctttcctgaaattgttcactgggctggactttcttatctggagctttctaaagcaggacatgcccatgagggggtctgataactgggccaaagaccaccagcgggagtgcgtcttgcctgtccccaccctctcttcttctgtgtttctgtcactgcccttttcctgccctctctgccctgaccagtgcatagcacctaatatagtgctttccaatggaatgatcagcaagtacttcttgagcaaatgcttggctgcaggaagcactgtagcaggagggtggagagggagaagctggggaagtatattcctggcaagtactttgtagacatctatctctttggttatctctctccccagtcttgtgccttgggatgcgtgctgatgctggggccacttgcaggtacccagacagctcggcccttacagaatgattatagaaatacatacataggtaccttacacacctagcaatttatgaattgcttaatctatgccaagcataataccccaagttttataatctcatataatcgtcacaattctaagggcatgaaacctattttatagatgaaaatactaaggatccaagcgctaaagtgatttgtccaaggccttatggctggtatgtagaaaaagccaaaagtgaaaccagagcctaggtgtttatagccaggagttaatgggtttgatggctgttctatagtcagggcattgcaggaagactcaagggtatggcagatgggtcgagctgatggacccctctcgtgtgtgatggaacaaaagaagctctaggggaggaggcataatcatctggctgtgggcagatcatagagatcctggcactgtttatccatctgaaaaattagcacacagatatcagctatatccttctcttcagatcattgcgaaaatcagatgggtctaatctatcaaaccactaccagattaagggaccatatcttgttcactcttggaacacagtaagtgttcaataaatgagaaacccgtgaaagaaaaataaagcctacttccttaccattaaaaaaaaaatgcttctgcttctcctctgtcaacggtgatcctctttttttcactttttcttccttttgtgtcccccttcttccttccagccaacccatagcactcacccttgggccctggctggccacacctcagtgggtactaactggtgagtcccagctggtgtgcactgggccgcccatgagccctggacagcctggttgtgatggccagagctcactggtgacaaatgggctctctgtgcctgtgacctggtggggccaattaatcactgggaggtgctctttctgcattatatatggccaaaagcaccccttggagtcagggaggacaaagctttaggaggttttgtttgtttgtttgcaaactagagagacaaaaaggaggtgacaagggtagggggaggtttgagagagaaaaaagtaaaggtcaaaaactaaaatggagcaagaaaggtgataaatggcctgggctggagggtggctatcctgtttggcctcaggaaatcacattaatggggatcagtacagaactggtcagaattatgaaaaccattctcataatgacagagtttgaatgcagttctgtagccagagtacccaagaatgtcttcaaattataatcatagggtgtgtgtgtgcatgtgtgtgtgtgagagagagagccattcatgcgtacgtgcactgatgaagaaatatgtgtatgtgggaggtttgcaggaaaaaaaaatatgacggctgcatgagctgcatataaaccaacatgctattgagagatactcattacatctgtttttaatcacaacatgtaaatgtggggaaagcagtcactgcatactcaaaagatacaccttgaagattctttttgcatcctcagaaagtgccagaatctgctgtaagcaaaatctcagtgcaatccaagtcagtgccttttccttccccgagttctgcccacatgcataaagatgtcaacgtgttgattattctgattagacttttagtgtaatttacggggtccagtcattgtgcctgggtgtctggcctgcacttgctaccctgacgatgccatttttaaaatgtcagctcagccatgattcatggctgatgctggtgacattgctgctgacctgaaagagttaggcagcaatatttaattaaagcaaaaaaagaggagaagaagaacaagccaaaggaaagtagagggcaaaacctaaaaagaactaaattttgttgctggaaagatcagcatctccaaacaaggaagaggcactacaaatgcaatatattgtcacttatttgtggctctgtgtctacctatcatttgtgagtggtaaggtcatgtgtaatgagtgagacagttgtttgcatcccattcaccatcattctggggccctcattccctctctctgtggggatttgctaggaggtggagctatcactgcctctggcttttgtcctcactgtgtgtgtatcggcagcctgcctgccacccagctcgctaacggcagcagtacctgggcaccagctacctgctcccacccagatagcctcttcccagcttgcaaaaggccatgctcatttccaagcttctagctccaggatgctgtgcaagacctagggtgaaatgagtcctgtgccctgcacgttggtggtacaaatccagccctaccagcagcaacagtagccactgactagcattaagataggtacttggctggacaaagtgactcatgcttgtaatcctagcactttgggaggccgccgtgggcagaccacgaggtcaggagttcaagaccagcccggccaatatggtgaaaccctgtctctactaaaaaaaaaaaaaatacaaaaattagctgggcgtggtggcgcacgcctggagtcccagctactcgggaggctgaggcaggagaatcactggaacccgggaggcagaggttgcagtgagccaagattgtgtcactacactcctgcttgggcgacagagcgagactctgtctcaaaaagaaaaaaaaccgaaacaggtactgccccaggcctcgtgaatttatttaagtgggacacaaattatcccttagaacacacacacatgcatgcacacacgtagacacacacatattatttgggaggtctactaagccgggtccctttgccaggaatgaaaggacagaatttctcattaatgggaaggccacagtgagctgaggtttgagaaccagaaccagcctttgtccaggcctgcgggagccaggctattgtcttctaggttccccttccccagtgaccccagggtcgggggcacacatgccggccttgaactctccgtctgtctctcccaccatattaattactactccctttggtcaggctaagaaaacagcctcaactgcattaggactaattaagaagagtgagcttcccattctggcagcctgcatcggtccatgcaatgcacgagccaggaaggggccctgacaatcttattaccacagaagaaaacacctccccgcgctccctcgaacccccgacagtgagttcacctcttccattacaaatgcatttgcccccagccaccagccaccagcgaggacagcctgggtcagccaggcatgcagggtcgaggaatagccatgtttccttaaaccgaggggagttagcagagcaaatgcagggtcatgtccatttataactccatctgttgccttcctcctccctccccaccataaataaattaatagacagacagagagatagaataaatatggatcactacaagtcattatcccttaaacctgccacgctctccattgaagctcacacatttacaacctgctcaggagttgaatccaatcctctggattccagagggtctgaggcccttctataaggatctgaagacagtaattattggaactgtcttctctattgcgttcttcccgtcagcctcaccatgttaaatatccagtgaatactgcaggggcctccaacagactccagccactgcttgctcccattcttccttcacgaggccaccaaagtcatattctaaaggacatccaggtatgccactggcctggtttacacaacaccctgtggacccctccatgtctagaggaaaacccttagcatggtttacaggctctttacacctggggcagggccctccttcctttttcatcttttgtcaatttttataggccatatctagcaactctcccaatcaccctactctggggatagcagcacagaagttctatggttcaagagagcaaagtaggtaaagtaagctataggagagtgaagccgatagagtccagccttcccccatgcccaaggggacagctgctactcacctcctatcaaatgtcatttggaaataaagaccttcagatatatatataatttttatgagatggagtctcactttgttgcccaggctggagtgtagtggtgcaatctcgactcactgcaacctccgcctccagggttcaggcaattctcctgccttagcctcctgagtagctgggattacagatgcccgccaccatgcccggctgatttttggatttttagtagagatggggtttcatcatgttggccagactggtcttgaactcctggcctcaagtgattcgcctgtcctggcctcccaaagtgctgggatcacgggcatgagccaccgcaccaggccaagaccttcggatttttttaagccaatttttaaaaatgtaaaattgccagattttaaacgttgagaactaattaaaatttgaagatggaacaaaatatgtcgacccataggcccccggtgggaactctgctctctagtctggttgtccctaccaggctgctcacagctccctgggaaaaccatcctcgctcccccacagatggcttggggctctgccttccctgacttgtgtaattgatgagagccttctcttccactcttttctgttggttcgagacagggccttgctctgtcgcccaggctggagcgcagtagtgtgatctctgctcactgcagccttgacctgctgggctcaagcgatcctcctgcctcagcctcccaagtagctgggatataacatgcaccaccacacttggctaattaaaaaaatttttttttgtagagacagggtcttgctatgttgcccaggctggtctccaactcctggcctcaagtgatcctccctctttggcctctcaaagcactgggattacaggcacgggtcaccctgctggctctcctccactcaactcattacaacctgccatccactgccttggcttgaggttgccaggtacactagaatgcccagtgccatttgcatttcaattaacaatgaatccatttaattaaagaatgccctaaatattgcatcagacatacttaaactaaaaatgatgcaatatctaaaatttaaatgtatatgggtgtcctttatttcctccactaaacctggcaaagctacctcagctacaccacacccaccttacattctttctgggcactgttctaggtgctgaggacacagcaggaaacaaaacagatcaaaagaaaatccctttgcacatggcgcttctgcgggcagaagagagggtttcctcttctattccaacatcattttggctcaagagttataacaggagtaggaacaagaagcattgggttggagccctggctcttctgcctgtcatttgtgctgctgagcctgtgggggtattaatgtccccatcactgaaatggggcaacagtgcctttgctgcaggtcatgaacaggggaggtgacacatacacacttaggacaatgtctggcatgaagtaagtggccagtgcattgaaccaggtgacacatggcactatttcttaatcgtttccatttctgtgacccacttagcccaaaaagtccctcaaaggaagggatgttgcgctaattacctttgtgtttccagtgcccagcacattgttgggacatactggggacaaaatgggtcagctagtgggtcacaattgtgcctgctctagaacataaggtgtggatgttcactgtctccatagaagtaaagagaaatggaaatttgaagcaagttttgtgataaagaaggacaaacatctaattacagagaaagagtggatttctttttagcctgaattatgcaatttgtctattaaccctaaacggcattgacagaaaattcaccttgcttttcctttatacatgctaaggtagtctgtttctagggatactcttaaaaataaagcactctaatttttatgggaatctgtttttttgtattttttttttttatgtcagccaggcacggtggctcacgcctgtaatcccagcattttgggaggctgaggcgggcggatcacctgaggttgggagttcaagaccagcacgatcaatatggtaaaaccccatctctactaaaaatacaaaaattagccgggctatggtggcatgcacctgtgatctcagctactcagtaggctgaggcggcagaatcacttgaacccaggaggtgtacgttgcagtgcgccaagatcacaccactgcattccagcctgggtgacagagggagacgctgtctcaagaaaaaacagtcttctgattataaaagtacatatatattccataaatgttccattatttataaatttaattactgattgttagacatgcagttaatcccagtttttattatttagaataatgatgtaatgaatatcttttatatacaattccatgatttatttccttgggagagaaaatcccagcaatttggtcaaagggatgtactttgattacaatactggaaatgtattaagtacatggcccccaagaatcctcaaaccaagtgtaaggaggcaggcgatggccttcacgggacaagctggggtctcccagtagtgtcattggaggtgagtctctgtgtctggagaagcaactagaccttgggactctagtttcatccccgagattctcctccatttgacaaggggaatgtttgggtttgagtttatgaaggcagcgtgttgctctcttataccaagaggttcttcagaactgctgagttctgagttccgaggtcaccctgagcacaggggaaattttcatctttaaaataaaaatccgtctccgcctaggtatggatgaagatttctgtctaagcacaagaaatagagtctcgtggtcttcaaactttttacagtctcagagccttgttttcaaaagaaatttgatactagggatagcaaatgcatggtttctaggccattattctctcatcctgtacctactgattacagtgctctctctctcatacatccaagacttggccttggggtcttccacacagcaatctaggcagcccctattaggtggctggagttagcatataactccatttgatagactggatattgaaacagacaatataaagcagatcaattggagtgagactctttgacaaaggggtgaggagtccagagcccaacccacttccttcccctctgaaaagactcttgggaatcctatgtgatccactgatctagttgatctgttcttatccctccaaatcccagcacttcaagattcatgcattctgttattcacatatgaagagaatgtttcccatatgcaagagctgttgtttgtcacctcatgcctctttgccatgtaattcctgttcactggatcaaggtataagtagaagccattaagatacagaaagacccactgctgcacccacagcaatgtcagcatcagggactgagcagcagaaaccgtctgtgatcctaagagcatcttagaatcgctctgtgtgtttttcttcttcttttttttctaccttgggctgcaagaggctacacaaggctccggatagatgggttttattgaagtcatttcaagctcccctgcctccccacagctgacctgacagagacagttaagaatcatctaattaaaaacactgatcattgcagtaccaactagatcatattgagataatcactctactagctcccaacgaggtcctgctgagaataactcctggccaagccacaggagggagaggctggggcctcgccactgtcctaagagccctgctgtgtccctggctttctctcctggctggggggatggaagggacaggcaggactatttattcagctcaaggtcctccgtggagtagagcatctaggcaggtcggggcctgctgccatggagctgccactgagtattactatcactccagacagcggcatgtcccctgcaagagagatttgaaaccccacaagctcagccctccacccccttgttctcccagacttataaaaataggaagaacacatgttcccattagtcacttgcttgagggctgctgtggggtatatgcacgcagcctgtacactggaaccaaatttgaatatcatttgcatcttgcaggtagacaatagataccgcatcaaaaacatgcacagcaccccctcctcagcaaggcgcccaatgaggcagaccagatgacatttcctgggaacaaggactatcgtttataagttttcaaatccacttgataaggcccctcctggcaaccgacgcccaccccagctggagaggcattctgagaggcttttaattaaacttttgcttgccaagagcagtttgcatacacacagggggaccatgctcctaggggagccataaagcctgccactttctttgcctctgtgtgtccttaactctctggggttacgaggcagacgcccagcctgtactggcaatgatgcttctggaagggcctggggagtgagcctgcagcggcagacagagctgagcccactctgcggctgcacggtgcctactgggtgagccgtggcttcccggccgcctgggtgactcccagggcagtggccagagtaaaagccagagaggacgaggctgcactggggttatgtcatggcacagccagagggagaaagactggaaaagccttcagaccccacaggtggcttagttattgacttgcgtgtcccttctgggaggggggcgagctggaagaggaggcgtcctttgtggctctgacctcccttgacctgacctttgtaactctatcaggactagtggtcagtagttatcaactgtcaataaaccgcccaaacacacactgtaattcagaatacggggaggcccatctatttgctgatcgatcttggactcgaaagttgacaaaatgcagggtcccttgtcttcttatcataatattgaaaatatgtgctgcgacacattgaatgatctacacttctcgtgccccactcctggggcccttagtaaatacaagaggattgattgagatgaaaggtgaacgggaggtctgtggtgttcctctaaggaaaccaaagcccctgaagcagggactgaggactaattagtccatctcattaagtttatctactaaggtcctatggaaacaggctagggctaccctgccccagttatctgcttcatttaaaaacaatctgcatctgcttgaataactgaggcaaaaacagactttggaggctttaatgatgtattttaatagaaatttcaagttcctggcttctctccctacccctttccacttgactttgtgctgtgttgactcatctatggatggtgttttttttttgttgttgctttttcctgcagaaaacaacaatgtgtttttggaggtgatcagataacatcattgaggttgatctcaagatgtggaacagtgggctgggagtgctgggctggccttctgttctccagttgctgggacaatggtggaggtgaggaaggtcagtgacttcaacagtcctctaagtgggtctgactgaggtacccactcaaactgggaaaacaagcagcttggctgacgccgtccagtcagtggccggcatggctatttacacggggcattgcaagtaagagtcacacctgcctactagagtcgtggggtggattaaatgaatgaatacctctgcaatgcatcaatagtgcctggcaggaagtaaataggactcaatacatgttatcagtgatattatgatgttattaggattgtggaatcatcctcattattgtttgaactggctggctggctggctggctggcattgtgttcagctttcaggtgcacctaggcagagatttcccaggtcacacctgcatgatggattggcacaaaggaggtaaagtaggtttctcaggcttgggactcttgatattttgaaccaattcattcttttttgagacagagtttcgctcttgtcacctaagctggagtgcagtgatgcgatctcggctcactgcaacctccacctcccgggttcaagtgattctcctgcctcagcctcctaagtagctgggactacatgcgcccactaccaggcccagctaatttttggtatttttagtaaagatgggattttgccatgttgggcaggctggtctcgaactcctgacctcaggtgatctgcctgcctcggcctcccaaagtgctgggattacaggtgtgagccacagcgcctggcccaattcattctttgtggtggggctgttctgtactccgtagcaacttgtgtccttagatgccattagcacttctctcccctcatttgtgacaaccaaaattacctcccaggcattgtcaaatgttccctgaagggcaaaactgcccgggatgagcagctctgggataaagccatggtcaggagtcacagttcccatttcgtgtctcacctgctatcctagaaccaaggcctccactcaagttctcccctgttctgagttggggctcacaggtactcaccaatgagtcaccctcaggaccttaggaatctgctatttggggtcaggggtatctgctgctgaagcctgggcggcctctgcagacctcaagggcatcctgcctggtgtctgcaccagagccctgttacctgctgaggctcactgaatgggtggtgagttctcccacggcccagtgcactagggatggctgctgttttagtccgttttctcactgctgataaagacacacctgagactgggtaatttataaagaaaaagaggtagcccggcgcggtggctcacgcctgtaatctcaacactttgggaggccgaggtgggcaaatcacctgaggttgggagtttgaggccagcctgaccaacacggagaaaccctgtctctacaaaaaatagctggccatggtggcacatgcctgtaatcccagctgcttgggaggctgaggcaggagaatcgcttgagcctgggaggtggaggttgtggtaagccaagatcacaccattgcactccagcctgggcaacaagagtgaaactccgtctcaacaaaaaagaggtttaagggactcagagttccatgtggctggggaggcctcacaatcatggtggaaggtaaaagtcacgtcttacatggcagcagacaagagagaatgagaaccaagtgaaaggggtttccccttataaaaccatcagatgtcgtgagacatattcattaccaggagaacagtatgggagaaaccacccccacgattcagttatctcccaccaggtcccttccacaacacgtgggaattatgggagcacaattcaagatttaggtgcagacacagccaaaccgtatcagctacccacccactgccactgctaccagggttatcaagaagccatgaattctgctaccatcaactcaccaggacctccccttgctttggctgtgctgttctttgtgactttgatgcaaggaagccaggtgacatcctggctgaagtcaggggagggtggggtggggaatggcttccttcctgtttgtttgtctctatgctctggtagatggacaccaaagtgatcccgtcttctccctggatgaggcatagagcttcccaagaccctccagtgacacagactcccctgagttctaaatcacacctttcttccctccacagatgccttgaacttgattcaagctggtcttgcttctcttagattgaagcttcttcagttgtttggctagacaggctctggggaggcctggagctcagcagtctgcctgacaccgcaatctggaagctctgatgtgtaggaagcacacgacttcttacaaatagtagaaacttaattttggagtaatattaggatggtgcaaaagtaattgagggttttgccattattttcaaaggcaaaaaccgcaattgcttttgcaccaacctaataccgtattttgcagatgaaaaaacttagggccagagagattaaatgactggttcaaggtcacacaattaactagtaacaaaggcaaggacaaaatgctcagttccctttttggtgtctatatttaactagcaaactacaaaaagtattataccaattaactaattttaggaaagggattttgtataacatgcctttttatctgacattggaatagggggttttcatatgttattgtggtgggaaattgaagcgtatcccttcatgcctcaaagcattatttttattttaaatattttcaatgaaatattcctaagacacattaaatgagactcccccaaagatttttacctcatcagtattagtgtgtgcattttgtgttacatccttttcttcctatagaagacatttccccccattacttttgacatttacatttcattccaaatagtcaaaattactatatataatttctacataaatgacataattattattattggtattttcaccaacaagtctatgtttactagtatgtggaggctaaaactgtttccaagtgggaaatattaatcaaaagaaagtcaaatctcgctattttccaggtctgccctgtttgcaaagtttccccattatgcatgaatgcgttttaagttttcaaaatatttgcaaaccaaaatggtccttgcaaactcttctgtagtctttcttatcatcatgctactttctgaagccattggacaccagctgtaataaggatgatattctctttcaacatcagtgttcaactttttacttggcatctttttcttgagttgggtgttctaatagagtttgatttgaaagtcaagtggttctgggatcgctctaaacctaaaaaaaaaaatggcaaatgtgggtccatcaattttatgtccaaggcagaggaatgtcaaaagtgtatttgcctaactctctggttccagtttatcgctctctcccctgcctgcaactcgtagctccagagaatttcagctcatcaagaaaaagtacagaataaggcttgatgacattatcacaaagtcagattaacagcaaatggaggaaaacaaaaatgggctcttccctggtagagatgtttctctgcagaagggtggatgctgataatgcagtcactgggataagtccttcaatcactatgaactcataatggcccaaatgcaatcttgggcatttgaaccaaagcaacaaaaatcagaaagagagagcatgtgaagcaagttacaaaacacacataactagataaaagaaataatcatccaaatgtattttgaactgtaacgcattaatacttttccatgttgacagggaaaaacaataaacatcaaatgcaagttatattacgcatctatgcattgcctctggattgtacaaagttcaagaaagaagcaaaattcttgatatagtgataaagtagaggaataatcacattaatgataacccttaattattattactaaatttgtgttaaattagaatttcagaacctccaaactctttccttattttcagcatcctcttgaaaatttgagaataaaatgtgtggtaattgccccaacaattttctttttggaaacttcctacctacctagagagtgacagtgttttccaatggagagaaaatcagactcacaaaatagcaagagaagcgacagccaggaccagagacaaaggtgacagaggcccaaagcagtgaagccagcagttcccattgcactgagagtgcaaacctgtgagtgatagaatgccaaaaaggaaaggatggagatttggacaagagcagcacatctgtctcagaccatcacaggatacaacctggggggtttttgccttcctccctaaaccaaagcaaattaatagaacctagctttctctttcctggaaaactctctgagggtctagtgtcagcaatagaggcggggtgagaaatccatcagctgtgttacttgctagaaagttagaagagtcagccggcagaagggtgatgctgaccgggcttcttagttgaacagactgttgaatgatgaaacacagtttggaatattaaaagagccacctgggagatggattagtggctctgttttttcatgccagctttgttcatctgattttgctacctttgagctcagcgtgctattgcaactgaccttcatcttgagatgaagtgcgcgtttaggaatcacggacatggaatcctccagcccagtgtatttggacctctgcttgtgccaaagaacaactaaatgcaaaatgcatactatgcatgagggaaatcactgagctgcttaccgatgctacactctttcactccctgtgtgatgtatgaaaagcagactgcaattatataattagactgaatatacatttttcccattagtgtttatttttgttgccagtcagattgcctcctggaaaatggaggctgttagtccacgtggtcatccctccttcccccctttcaagatgttttgctgatctgctttgatttctttttagcagcctgctgattcttctctttacgggtgctccttggagtttgaggggctcagaggtgtgtggattgctgaaattggacacatgtggcatatttgccttgaaaggctgaggcttgtataaagaggcccctggcagctgactgtcagtggggcaggaaggggagagggacaaaaaaaaaaaaaaaaaaaaaaacacaaaaaaaaaaacaaggagaagggccaaggcttcaaaagaggttacggtgtaggcacggggttgagatggaggaacacgcatggctgttagcagtcaagtgcgttgttcacagtacatgggaactaagtgagggttcattgatggaaacagtacacaatttggaggaataaccacagagtatttactgaactgccaaactgcctggcagcaccccatctgaccatccaatgactttcccagaagtgcaaatcagaaagtcaataagacacctccagtttccaaattctatctcattgcacataaactgaaagtctcaacaatcaataccgtgttactgaattacaatcagaattcagtggagcaacatccagacaaacgagtgtgtccaagaggcatttgagtccatgggtgaactccagaaattttacatgggatgaggtgatcagaccaccaatttgggagacagaaaacgaacacaagacagaaaaactgtagtcaatctgcttttttgaaaaatagacccatttggcaccaattaaccattcccatttctccgtgcctgccacggaaagtctccagaagctccgactttgtgttaatttcatcagcttcatttctgacagattgagagttggatttgtaagttggaaatagctactattgattcacagtggtgcctgcctctacctaccttagtaatggttccaacgagatctatgcagctaattccaattcaccagccactattttggaagaagatgaacattttcaggacctaagggaaccatcatggccagcctttcaaatggctttgaaaaaatccatcagtctctcaaaatctgtttagctgaacaaattcccccagctcccatgtgtataaacaccaccactctgttttcctatcatctgccccttcctctttattgctctcatattagtagattaaaagatcagaagtgccagcttttagcaaatagattcatctttagtcacaaacagatttccatgagaatgaacactaagttattagggaagagagataagcacattatttgtattttaagcttgctgtctgatttctgtttggcatgccctgatttcttttaagcactgggaacacgttcattttccaggtttatataggggttgttacatatctagagtgccatttagaggattactaatttactaaatggtaccccagtgccctgaaagagttaattcttttccaagagataagcaatttattttctatttagcagcaggataaggcccactgcttacaaatggactatgagccccttagagagagggagagagagatgctgtaaaaataaagggtataataattacaattattgtaatataatgtcaatccatggtgttatttttatacattccccctcctaacctttgtctaaaagaccagatcaacatcctgaactccctgtcatttttgcatgtgtctttgaaaaaccagatgccaagagatgtgctgtatcctttggtaaaagagcccatccagccaaccaatcaatcaacagatgttccctaaacactgtaaccaaacagcaagcacagcccaaaacctgcctcccaagagcttccaatttagttggggtaataatgattcacaagcaaactccaagccaggggtaacgacgcataccaataggaagttcacgcaagtccagctcagaggagagagaaatcagccaccctataaagcagccatcgccaaccaccctgagctgggagtcagtgacaacatgtatcttctccttggttcaaattccagctctgccatttcctagatgagtaattttcatcaagttacttaccctctctgagtctcagtgtcttggaaaaccattgacttgaaatgtggggaagattcagcaaagtcaaatctgcaaaactactttgtaaactgaaatgtgctacagaagcacaaatacaaaaagcctccctgaaacgtgtaccgttttgagaaaaatgaaaatggtggaatgcgacatcgtgtgcggatgagaattttctcaacagttagtgtcttgggattcactcttaacaggactccaggtctctccccttctccagagagacctgggtcaggcaggcaggcaatgatggctctcagtaccaagacctgaagaagggagggtgggtgtgtttacagatgaccagaatgaaagaaatgttagggagctgagacaagtctctcccaagagaaggcaaagggaaggaggagcctggaagggaaaggacattcatgttagtttgcaggtggaggctagaagtccgagatcaaggtgttggcagggttggtctcttctgaggcctctctccttcttatatagatgaaccttttctccttgcatctttgtactgtctttcctttgtccacatcagtatcccatttcctctttttttttttttctgagacagggtcttgctctactgcccaggctggagtgctgtagcacgatcatagctcactgcagccttaaattcctaggctcaaggaatcttttttaaattaaaaaaaaatgtgaacaatatctttagtatcttttgtgtgcgtagttaaccatgtaagtgaaaaaaccccatgagatgacataggtgattataatagaaaagtggaaaaacaactagtgtctcagtattgaattccgaatagaattcccagtatatggtaatcttaaaagagacctgtttcttcaggtgagtagctgacccacctcagggccatgcccctcttctctttcctcacagccttaattttttgccaaaagggccagatttgaataaaggggagcaccatgagcgcaggatccaggcataagggctgctgtctgttgggctttggcaatgggtgtttgggaaattcttgggctcaaagaatttgaggctgcagtgagttccacctcagcctcccgagcagctacagacatgtgccacctaacccggctaattttttattttatttattttgtagagacggggtctcaccatgttgcccaagctgtccaatttcctcttcttctaaggacaccagtgatattggattagggcccaccctaacaacttcattttaactttattacccatttaaagatcctatctctgaatccagtcatgttctgaggtatggggattagaatttcaacacatgacttttcagagggcagaattcagcccagaacaacatgtaaattcatggctggatctgaagctttctttatatgacaataacagaaagaagggaaagaaataaatttgcaagcatggggagcagcccaaatgtttatgacatacttgtaaagatttgaagagcaagaaaacagctttgtggatggaagttacggagatgtgtgtctgtgtgtacatttttcttaaaaaatagacaattcccactcagagaataatcagagttcccggacatgataacgatgtacaacttattgcctagatctttcatgcaaagtttttgcaaaagatgatagtttcttctctgaaagtctcctccaatggacacaccacaagatcccttggagatccacggtgatcatttatcactttgcctgacaaaaagttattccttatgtcttacccaaatctcttgctaatggaagccaaaggtcagcattttcagccttatgactttggtgcattccttctctttcccattccctgcaaatctattttcctccttccctccttctctccctttctctctctatggatatggagaataatgattcaaaaatatccacataaaattccaccatatatttagccagttaagttactccttggctttttttctttttttggagacagtctagctctgttgcccaggctggagtgcagtggcgtgatcacaactcactgcagcctctacctcctgggctcaggtgatcctcccacctgagcctcacaagtagctgggactacaggtgtgtgccaccatgcccagctaatttttttattttctttataataaaatatttgtattatttatgatgcccaggctggtcttgaattactgggcccaaggaaccatcccaccttggcctcccaaagtgctgggattacaggcgtgagccaccacgccaagtccttcgctttctcttggtcaaataaatattacacattctcccaccactgccacctgatatcctagatttagcttttcctcaataaaatattagacaaaatactcctacattttaaaataatgatttctagtatggataattttttcaagtcccatgaagtgaacaagctgctgttccctctgccatgaatatacacagagctctgatcccttgggtgggacttctgaggtacacttgccttttaaaatagaatattccgtataaacactttactgtgcaaaacagctgatcagaatccctggcctgtattgtatctaaaatgaccatttttctctaccatttctctctaccttattcaatgagtctggaaatcttttaagtttttttcccttagatttaatgtaatttgccactttttaaccacaaggtcagatagttcacacagcataaatgggatgcatttgtaagtctccattcagatatatgacatatacagcagccaaaagttatgctccttctaatgttaaaatcagtagaatatctttataaaaggacattacttgaaagttgaattccaggtgagcacatttatgtgagtggcctccagaaaacatgttctctctttggtgcatgtcagatagcaactgatggggatgcaactgagcaacactcaaagctctcaagtgaagtgcagcacctgtgcagcatgcaacaccatgcatgtttattctgtatgtgccacctgacctgtgctcacctcttagaaaaatctattcatggccgggtgcggtggctcacgcctgtaatcccaacgctttgggaggctgaggcaggtggatcatgagggcaggagattgagaccatcctggctaacatggtgaaactccatctatactaaaaaaaaaaaaaaaaaaaaaaaaaacaaattagccaggtgtggtgacaggggcctatagtcccagctactcaggaggctgaggcaggagaattgcttgaacccgggaggcggaggttacagtgagcggagattgcgccattgcacttcagcctgggtgacagaacgagactgtctgaaaaattttaaaaaaaatcttttcatatacaatgaatatagatgtatatatgtagttctgtatatgtatatacataattcgaatatataattcatgtgtatgtatgtatacatatgtgtatatgtgtgtatatgtatgtatatatgtgtgtatatatatatgtatatgtatgtgtgtgtgtgtatatgtatgggggggagagagagagagcatccatggttttcccagttttattgaccaaaatagcaccccttcaccatttttcaggcctcccaagatatttcccctgactttttcattggatttaaagggattttataaccatatcaattagaagggatcaatggtcaaggtctctacttgttatcaagcaggatagttccaaatggaactatctgagcagccctgagaagatcttcctgcctcccaggcctgctctacccagacgcaagatgcctgaaattcacaatcacatagtgtgccccagcataggggaaaaaatggtaaaatgttcctctggatttgatcacttcaggtcacagaaacccaacttccaacttctggagtctcattcattgagagctttgaccttctgaggctgctgcactgcctgtgcctgcggtaggcaggaagtaagagggaattaacacctgggagcaggtgtccaaatgcacagcagggttagtgtgtaaataaaatacaccagctccctttcccctgaggtggaataactgtgaggtgtgagttctacactcttccatgagttctgtcttgaaatgaagttcctgttgcccacagttgaaacttgctggataatgttctctttatgatcatccttctcttttcttgtttgttcttatgcttctctcagttcctgggatcaccttacaaataaatgaattttacttgaatactttcctgaggatctgtttctgaaatgaagacaatgcactcattcatttggcatagcctcagtaacacaaagttatggtctattaaggtgtggaatcttaagtctgagggggaaatggtggagtacatttggatcacagaatcttcctgctctggaacatggatggagctggaggccattgtattagtcctttctcatgctgctatgaagaaatacccaagactgggtaatctataaagaaaagaagcttaattgactcacagttcctcagggctggggaggcctcaggaaacttacaatcatggtggaaggggaaagaaacgtccttcttcacatggtggcaggagggagaagtgcagagtgaagctggggaaagaaccttataaaaccatcagatctcataaaagaacccactgactatggtgagaacagcatggggaaacctccccagtgatctaatcatctcccacaaggtccctcccccaacacgtgaggattacagtttggattacaattcaaaatgagatttgagtgggaatacagagccagaccatatcagccattatccttagcaaactaacacaggaatagaaaaccaagtgctgcatgttctcacttataagtgggagctaaatgatgagaactcataaacacatagaggggaacaacatatactggggcctaccggagagtagtgggtgaaaggagggagagaatcagcaaaaatcaaccatgggtactagacttaatacccaggtgatgaaataatctgtataacaaacccccatgacacaagtttacctatataataaacctgcacatgtacccctgaacttaaaagtaaaacaaaaaaggctgggcacggtggctcacacctgtaatcccagcactttaggaggccgaggtgggtggatcatgaggtcaggagatcgagaccatcctggctaacacagtgaaacaccatctctactaaaaatacaaaaaaatgagccaggcgtggtggtgggcacctgtagtcccagctactcgggaggctgaggcaggagaatggcatgaacccgggatgcggagcttgcagtcagccgagatcacgccactgcactccagcctgggcaacagagcaagactccatctcaaaaaaaaaaaaaaaaatgtaaaacacaaaaacctctctgctccaacatctaataaaaggaacaagaagtagtgaaaaaaatcaggaaaacaccagcaacagtcaaacaaagaaaatggtagaactacaagccataatcttcaaaaaaagtcagcttgggaagagtaggacaatgattttggtgtaccacaacgctgcttttaaccataccctgaatcccagaatgagtagaaagaagtaaagaaaatacttagaatgttccctgaataccccacagttcggagaaaagcaagccaaggggtgtataggcatcttgggtggagtcaggaacataatttcaagattagaagctctctacctcttgctagaggcaggaacattgcctctataaggacatttaacagaatttcatgaaaaggagcagagtccctggttctgagacacagcccatcagagcaactcttcccactaaagacccaatacagacaacagatagaacacattaaactgctgctaagaggaaagaagggtctcaggtaaagcaggaagttggtcaagaagaatttatttaatatctgttagtacagaggtctacacggagctctacatattaagcaagaacaaaataaataacagcatgaagggaactctatttttaataatggcaaacttgtcctctcagactaaagctttgctgaaaacaacttcatcatgctgtaaaaaatagtaaaaacaccttaaaagcattgaggagttgatgtgaggtaaaggagttggtcaaactgaagggcctgctagaaccctgaaagaaaagaacaggagaaacattctttatccacaagcagtcgccaataaggacatttgccaaatcagcacatttggatgttggttttgacagccttgctgtgtgtttgtgggggcagggggcaggggcagatattaatgctcagagcccatccagggtaacgaatctagtaagaaacttcttcacattaagccaggatgccaaaagattatacattaaggttgaggataataactttaaaaagggaatgaggtatacaaaagagatgaaacacccatctgggagaaaatacaacccaagggaaaacaactatcttttttagtactatgccgtagaatagttaaatatggcacacatttaccaaaatacaaactaagtggtaagctattaaagtaacataatgatttttaaaaagactttggagcttagggaaaaaactgcggactaaaatgtcattatagaactaataaataaattagcacagatagtatgaagtagacaagactgaaaatagaaaaactgctacagggcaaaggcttgagaaagtctttagtgaacgaaaaggaaaagataaaaaataaggaaggtaatagaaaaagaaaataatagatgttcctggagtagagactgcgacagaaaaaaatcatatataagagaaacatgaatgtgccttaaaaggggaaggtgtatatttatatacgtgtgtgtgtgtgtgtgtgtgtgtgtgtgtgtgtgtatcttcctcttttaaggcacattcattttttcctatatatgaattttttctgtctattgcattctctattcacagtacattctatgagaaactaatatgaattttttgatcctgagtatatcttaaagaacaaagaaaaaattctgtatttattcagaaagaaaactcatgtactctataaaaggaaatttagataagccacagtcttttccataacatccaaaagacaagaaagccatatttacaaggttctaaagaacaaggaagtatgtttcatagaatataatgtctagtcaggttcatgtttgaatataattgcaacactgaaatattctcaaactcggagtatgacacctatgagtccatgtattaatcaaacaaaatataacaactgtgcagttaaaggacagtatccagtactgtgagacaatggacaaaggtctaacacattttgagggaaagaaagtgtgattcctcaaattttatacccagctaatgtgtcctttcatttattcatttattcttgtgtgtttatttttattttattttctatgccttcacagtgcaccttgagtataaaggtaatagacattcttaggcatgcgcaagaaattagaatagagcatctaacgatcttctaaaagtcttcttaaaaacaagctgggcatagtggtttgtggctggagtcccagctactcagaaggctgaggcgggaggattgcttgaggccagaagttagagatcagcctgggcaacatagcaagaccccatctcaaaaaataacaacaacaacaataatataaactcttcttaaaaataaaattcgcctaataaaggtaaataaaaaacaatgaagaacatgaatctaaaaaacttgagcacttaattatttaatatagaagtataaaatatgacaaaatgaatgtggcttgagaacaagatgacaaatattacaaaccttgatgaagtaaaacaataactagtaaaaggaggtaagggaaggaaattgagtagctgtgtgctaattttctcatcttttaagcaaggagtcagtcaatattgtctaatactgaagcatgaagttaaagtaatcgatctagaaaaaggttttctccattttttttctcttaatcatagattgtttcagaactatattctggcaaaaaaaaatgttttcttctgaggatcagaaatgcttcaatttcaagtctatattttttgttaaattctaacctaacaatgtctacccattaaatgcaatacttctgatatttgtcatgcataaccctattttaaaatatttaaataaaaattgtacatattcaaggtgtacaatgtgataatttgatatacatatacactgtgtactgattaccacagccaaattaattaacatatctatcaccacctatagttaccattactgtgtgtgtttgctgggggtgaaggtaccttaaatccactcctatcaaacttcaggtaaacaacacagtgtttttcattacagtcttcataatccctttttaaaaatctgtttttcttaacctcattgaatcttttattctctgtatctgtctcactgttctcttttctttcacgtattcatggtaaacaaatgcttagacattcaacagatttgaaagacttttttaggtggtagaagttttgatgaaattttgctttctttgtattctaccacttttaattttatgtagcggacatgtgtcatttttataaaaaaaaagtcattattccataaaagaaaaaatataggcttttaacacgtgtttgtggttttcatcttcgtgtttttcataattttgcttatggtatcaaacgaaagtagcaatcacttgactttactacatttttaaaaactctgctgttttctttagaagagctagcctcttggaaactgatgcttcttttctcttgatgctgccagatccctaactccgaatctttcatattttaatcctcaaggtttcctgaacatgtcgaaggagaactcaccaatgcctgcatgcatttgcagattaacagcttctgccattagcaaattggaaatcccttccctcatctttcttacagggggagtctttttctcctaatagtactatgattcccatttctgcattttcttattaatgtagtgtatagagcatttttatttttcttggctgctttagctttctgttgagcttcatgagtattaaatggaatggcttatctgagggaacaaagcaaagcaaaaactctactttcaactaatgggaagacggatctttaatacagaagcaagacactggtaggcaaacagtacatgggtcatgctctgtgttccactaagtcataaggctctcatgaggccacaggatacatgtttggagcaatgatgctgcctcagtgggtgagatgagatcagtcaagggcctgcagcttctgatttgaaaacaacaggcacctgatctgaactggggtgttcccagaatgtgacccaagctttcagcttacactaggggatatactagacttggtaagtggaaggacacaggccagatccatcaaaaaatgctttacaatgaagggcaactaagaatcgagagcccctacgatgcaattcctttagactacttgttacttgaattgaggtgactattagtggcaccaatcaatgaaaattttttctccctaatattttgtaaaatctgtggcttctcctgtagccagtatctgaaggcatctagtcaacgcactaaatatcctgttaacattgataagcatccttatttctaattaccagatgaatatatgaaggcattcttgttcaagaaagcatcggtatttttgctactactgaacaattaacatagttgatggagtgagccacctgcactctgggtgttttaagcatttttctaaattattattttggttattactactctctgagtaagatttttgcctcttttaatatttctgttaactgggaaatgaccccagatgggagatccttaggtttttgggcataaaagaatttttttaaaaaacggaactaaatacagcagaaaatgactataacaataacatacacgtgtgcatattttgaacatattttaggggagaactgttccatgtgataaacacaacaccgtcattttgagcccaactttcttcttgaaaaatatcaaagattttgcttaagttgccatggacaaacagacttatagacaattcagaatcatttggagagatgagggctacatactgtatttaactttcaaaacacagtaagtagattgagctcagcagtacacaaagagctgagagtttctgggataaacacatgggaatcagtgggagaggcagaaaaaggagactaaagattacaaaattcagtcacatttcaaaattttctgctacaataattcactttatgtagaattaatgtgtctgattgaacgtttgtgctgtaatttacttataattaacattttatggtgaacagatttctccacctccttcatgctgtgaactctaagccataggtcaaaaatagagatgaaacagataagcacaaaatattctcactgaaacattaatgagattttaatttactgctttaaaaacacatctttcatcaacgtctgtatataaaaatcacctttttattttaattttttaatcacattaaaaatataatgaactcttctagctggcagaaagacactaaaaaatctgatgcaggcaggcagtcctaggtagttaaatcattttccatcttgttcaggagccaaaaatattgtcttgtgaagaggtaatggtttagttcaactcagccaagaatctcttctcaattaatcagtgcattttgataggtaagaatttcttgcaaatggtgaccctaggaaaaccattcctactcccaaactaagacatttgtgaagaccaaaatgtgggtgggccttccatttgttggatttacttaccttaagggagaagcttgtgcctgtctaaagtttcaaggtagaacaataggatttcaaatgaagtgaggaattgggagcaagaaattttcatttggtactgaagttattacaaagtgctgccttccaaccaatgattaccatttctattaacgcaccagacattaagtcattaagtctcttattactccttaagacttgacctaaatctctctttctcaaagaggttacctttggtccactttgctgcaagcatcaatcatatccagtccttctccattgggttggactgaccatgagatatctgtctacttacctacctacaaacccacccacccacccatccatccacttaatgtgtgtctttcatgctaaattataaactctaagaggacagtcccacatctgagttacttatcgctgtaactggccatttgtaataggtacaataaatgtgtgttgactgattgaattactgggttgtcggttggccctctgggcatgaaatccagtgtgatttgttgtttccaaaaaagttgtaactagttgattccccattgagaggtagagtctactgttccatccccctgaatctgaactgacctgtgactgctttgtgtaattggatgtggaagaggtgactgtgccagtttgggccctgcttttaagaggaccagcaggttcctcttccctcaacatggaacatttgctctggagaatgttaactgccttgtgagaagtctcactaccctgagacttccatgccggaaggacactcaagctggtcacctaaagagacggtgtcagaaaacagagtgtaacactagccaccttcagctgttttaaccatcctggcccaggagccagacatgcaaatgaaggaaccgtctcaaacatttcagacagtccagccccgtggattccatatggaaaagcaagtgtattagtctgttttcatgctgctgataaagacatagctgagactgtgcaatttataaagaaaaagaggtttcatggactcacagttccacatggctggggaggcttcacaatcatggtggaaggtgaaaagcatgtcttacatggcggcagataagagaatttgtgcagggaaacacgtctttgtaaaaccatcaggtcttgtgagacttattcactatcaccagaacagcacagaaaagacccacccttatgattcgattacctcccaccaggtccctcccacaacatgtgggaattgtgggagctgtaattcaagatgagatttgggtggtgaaacagccaaaccgtatcagtgaggctctggagtgagttgcccatcttattgtcaccctgaggcatcccagctcagccttagacatcagggagccgaggtagggcattcccactgcatcctacccaaattcttgattctttattatgctcagaatccatgagcataataaaatcacagctgttttacaccattgtgttttgggatggtgtgcatggcaacaatagataagagaaacattctaagagtctacagtatgcaccatgtctttgtctcaatcttgggtacccatgacattttattctagagagaaaatccagacagaaccatgttccacccggatctcttttacagatgatacaaagatggtaggttctttgaagtagactcgacagacttagtggaaattttgaacctgatgccgatcccaaaggaataaatatctcaagaggagttcattcgtgttctttgaattccctaagacagtaatgggaccattcaagctaccaaattcagcaattttctcagaaatttgacttaggttagttagcaaaaatgaggctctgtttcctcactctcacagccaaatttctcaaaaaaaaaaaaaaagccatttacacagatctcaatttctttatttttctattcactccccagtccattctaagtcttcacaattactgcttccttttcccagttagggtatcacccccctctcccccacccacccaataaagagtgtgtgtggctcagggagaggagcgagactacaaacacaaaagcaaagatatatctgctttgcataagttacatcctgtcctttcaatcacaaatcttctataatgttatgcaaatattcaagacttttccatcatttatgataacagtgttgggaaagctaggatattcaagtataagacagttaaaaaaaaaaaaaactacaatagaaaactaacctgggctttgatttatcttctccaagttcagaccaaatgagaatgaagaccttttatgccaagaacatgctacttatttttcacacgatttacaaatggaagcttgtcattacaaatcccgatgtgactcttttttgaaccatcatgacgttgtcaggtgtccatcacagatggagtagctcataaaattagaatgaccccttgatagaaaacaagacctacacagacctggttttcataccagccacacctgcttttggaacaaaggtgaatgcatttagttcataaaaatagcacctcttatctgagaggtccaaatgcttcccaggaactttacatttgcattctcagagtttggaaaaagtggaaaattgattgcgagaatagagatcattcatccagttccttagtgcatcataggaacatgcaaactaaagagtgaaaataaagacccagggggctaaacaaaatggaacatacatgatggttctacattcttcccaccccagaggtccctttgttgcctgtctcaactcaagaacattccatgaaaagaaaggtgatgctgaagagagacccaggatgtgtatgtggaagccagcaaaagctcataattcaatgaagtcatttcattccctttactttctaacaagctccaacccattcaaaggacttattagaatttcaaatgaaaagctgaatactatgagcattgtaaatcagctacaaacagcttttaaaactgtgtcaggagaaatacacttgtaattttcttcctttttttaaaatattgcttttttttttttttaacttcaaagctttgtttgttaagaagcagttaccaatttatttctacagaaggaatctgattttggttggagtgagggggcccaattggagcaatcctttcacctgggttggtacgcgctcccagcattataccgatttgtggcacatgcactactatccaggtgctgggtgtcccttgacaaaccacattgcgttatttattttattgttgttcttcttcagatttcttagaacccgaagcagaaatatcccttacctgggaagaactgtgattcagactcctccagtcctggagaccatatgtggtctttaaaaatgtccaaacaagaataggatgccaggggagccgtccgtctaacggggccagcgggcagcagagtcctcctcaggagtcaggagcctttctcctcttgcaaggatgtcccgcaatctctcatatgttcatctccctgagaacttgacagggtcgtgagacagggatattttatacttgttccttgttctccaagtccctggaaagaaaagaaatagatttctcaatttgtaaaaatcttaaactgagattaattttcaaatagaagagatacattcctccccactttccccctcccttccttcctcctttatcttcttctgcagcacagaaggcccatgtgattacctagatcaccttccacactacccaaagcaaaaagacgaagtatcacagcagctatatccacaggaaaacatccacagcaattgggcgtccttggtgaatgttactttctttacacagaacgcttaccactaacgacttgcaaaacataggacactatgttctgataggcaagaccacagccagctttgacagaaagaaggtgctactcagaatcacaagcttctttctctcttctgtttcagttctgaagagtagctgctccaatgtcaaaatgaaaattacaacctccaaattaatagagtgccgctccaaggcctggagagtgggatccagatgcaccttctatcgggatggaaaagatttaatcaagctgcactgactatttattgaacacagaattactaagcatcaactactgaaaaccatatgcatgacctttaaaaactgataattctctgctggcctcccctttaaatcttgcaattatattccgagcaaaatacttgaacagccaagtcagaggagtgccccaaaactccgcttcagcgaggcgtaatagaagggtctggggctgttgaaagggacagattggagataacattcaggtggaaggaaatctactgattactttggttagaaatggaggtaaaaccaccacatatagagggtagcggagccttgtgcttctgagcaaactggtagaaccactctcttccctttcctgcaccacctcccccaaccagcataaccctcttcctattttggagaatttttatagaggaaagtgacagttttcttccaagaggtggcatctctctggaaaccatcctggtggacaaagcgataatgatgagaggcccccatgaaagagaaaatgctggcatcaggaatggagaccatgaggtctggtctttcagggacagtttcccccatcggtggcagccccagagcgcctggctttgactgcatcacgtgagctggaaagtttccttctatgcaaatctgcattattagtagaagggccttgaataagctgctgaacctctctgaaccacattcagacacttacaaaacgagggagtcggccgggcacgctggctcactcctgtaatcccagcactctgggaggccgacgtgggtggatcacttgaggccaggagttcaagaccagcctgaccaacatggtgaaactctgtctctactaaaaatacaaaaattaacctggcgtagtggcgcatgcctgtattcccagctctcctgggaaggctgaggcatgagaatcgcttgagcctgggaggcggaggttgcagcgagccgagattgcaccactgcactccggcctgggcaacagagcgagactccgtctcaaaaaataaaataaaataaaataaaaatgagagagtcatacctacttcatggtgatgactcagtgaaggaatgcatgggaagttctcagcacacagcctagctctgaaaagcttgattggagttcctttccatcccaacttccttcccaggaagatggagacactagctagctaaataaggggcacttaagctcaggtgtttaacagattctccagcactttataggtgctggcttcacaggaaggcacttgaaccattttgtcctgcaccatcccgcaatagacacctgttcttgaaatgacttggttttcatttctctgtttcctggttagtcaacagaaacatctatctttatagaaattactttcaaaccccttctctctcttattatgcctctttctctttttctttcttccttttctatacacattttcagccccagagtggttacctgccaagacacccaagtagaattcttttttcttttctcctttctttctttctctctttctctctctctctttccttctttccctcccttcctccctcacttcctccctcccttcctccctcccttcctcctttcctccctccttcctccctcccttccttccctccctccctgagtcttactcaattgcccaggctggagggcagtggtgcaatcttggctcactgcaacctccgcctcccgggttcaagcaaatctcatgcctcagcctcctgagtagctgggattgcaggaacctgccaccacaccctgctaatttttgtatttcaccatattggccaggctggtctcgaactcctgacctcaggtgatccactcacctcggcttacacctgacttttgaactgctctttagacccctgctttttgtcttgatgcgggttggctccctcggtcacctctccctaccccaggtcacccccaacctttatcgcattttcttatgcttttgtatgatagttttcctttttagtaaaaacatttaaaatgatttccgattgtctgctctgtaaactcttttccctgttttaaataattaaggaatcaatatcattttaacatatctgtaagtcttcatattagtaacaactgaaacctccgtacgatgacatggagaataaacatccctgtctatagcattctaaacgacttacccaagaagctcatttgcctaattactggagttaatgaaactcttccatctgcttttaacgtctcactttctatcacacctatctgccctgtttatgggtatcagtaagatgggcaatagcaaagagtagacacgtatgtgagacatactgaataattcctccaaacagaccagagaaaacacaaaaagttaattttaaatggaaaagctcatggagtccctggatgtggtgagttccttcttataaaaactaacctttttattttgagataattgttgattcacacgcagttgaagacacaatacagaggtaaatgtatatgtatcatttgccatttcctctgtattagtccattttcatactgcgataaagaactgcctgagactaggtaatttataaaggaaagaggttgtctttttgttgttgtttttttttctgagatggatggagtctcattatgtcgcccaggctgaagtgcagtagcactatcttggctgactgcaacctccacctcctgggttcaagcaattctcctgcctcagcctcccaagtagctgggattacaggcacatgccaacacaccagctcatttttgtaaattttttttaagtagagatggggtttcaccatgttggccaggctggtctcgaactcctggcctcaagtgatctgcccgccttggccctgcaaagtgctgggattacaggtgtgagccaccacgcccagccaggaaagaggtttcattggctcacagttcagcatggttgggtaggcctgagaaaacttacaatcatggcaggagataaaggggaagcaaggcgccttcctcacaaggtggcaggaaggagaagtgctgagctaaggggaaagagccccttacaaaaccatcagagctcctgagaactcactgactatcacaagaacagcatgggggaaaccacccccgtgattcaattacttccacctggtctctcccttgacacatggtgattatggggattacaattcaagatgagatttgggtggggacacaaggcctaaccatatcacctccaatgataatatttccaaaaccacagtacaatatgacaatcaggatagtgaccttgatactgtcaagatacagaatggttccatcaccacaaggagctctcctttgggccacacccccttccctcccattcccactctctccttaacccttggcaactactcctctgttctccatatctataattttgtcaattcaagaatgttatataaatggaatattacagtctgtaaacttttgagattggctttttttcactcagcgtaattctcacatgattcatctaagtggtcgcctgtatcaattgtttgctcttttttattgctgagtagtatttcatgttatagatattctacagtttgcttaaccatctacctactggaggacaactggattgtttctagtttggggctattacaaatcaagttgttataaatagtcatgtacagtattttgtgtgaacacaaatttccataaatgatctttgtggtataaatatccaggagtgcagttgtagggtggtgtaattgcttgttgttgttgttgtttttatgaaactcccaaattgttttctaaagtagctgtgtcattgtacattctcactagcaatgtataagtcacttgatttttctgcatctgatatagtttggatatgtgtccttgaccaaatctcatgttgaaatgtaattcccaatgttggaggtggggcctgggtgcagctaattggatcatgagggcagtttctcatgaatgctttagcaccatccactttgtgctgtcctcacaacagtgagttctcgtgagatctggccatttaaaagtgagtggcacctccctgccactttcttgctcctcctctggctacgtgatacacctactctcccttcgccttccaacgtgattgtaagtttcctgaggcctctccagaagcccagcagatgccagcatcatgcttcctgtacaggctgcagaactgtgagccaattgcctctcttctctttataaattacctagtctcaggtatttctttacagcaatgcaagaacaaactaatacagcaaccttgccagaatttggcattgtcactgtttttaaattatttattataataggtttgtcatgatatctcatcatccttttaatttatgtttcccaaatagctaatgatgttgaacatttttccatgtgctcatttgccatttgtgtaccatcgttgctgaaatgtctcttcatgacatttgcccattttctaattggattgtttatgttcttactgttgagttttaagtgttctttatatagtctaaatactagtcctttgttggatatggggtttcaggtatcttctcccagtctatagcttatctttttgttttcctcttaaggcctttcatagagtaaaagtttttaaattttttggagtctaagttatcagttttgcttttatgtgtcaagtccaacaaatcttttgtagtcctagatcctgaagattttctcttcttttttctaaaagttgtatagttttatgttttgcattgaattctgcaatccactttggattcattttcatgtatggtgtaaaccaagattgaggttcacttttgtttacctatggaagtccacgtatacaagcagcagtcactgaaaggctagctttcctccactgaactgcttttatacctttgtcaaaaatcatttgtaagtatttgtgtgggtctatttctgggttttctattcttcttcattatccgtgtaacaataccacacagcattgattcctatagctatttaattagtctttaaactggctagatgattcctctcactttatttttctttttcaaagctgttttagctattcttgttcctctgtccttccataagtatttttgaataattttcctatattacaaaaacttgctggaattcggataggaattagactaagcctatatatcagttttgaggaaaattgacatctttcctatgctgagtcttccatcaacattgaatgtctctccatttattcaggtcttccttgatttatttcatcagcactttgcagttttcaatatacaagtcctgtacatgttttgatagatttacacctgcgtatttttttttagctatggtacatgatgtatttttaatttggtttccatgtgctcattgttagtatacagaagtgcaattgcttttgtgtaagtttatcttatgccctgtgactttgttgaagtaacttattcattctaaaagctttgtcattattgttttttgtagattccttgggattaaaaacatttttattctaatcctaaatttccttatcccttgagattttcaatgttgacaattatgtattttgcaaataaaaatacttctttttcttcctttcttatctgtgtacctttgatttctttttatgaccttaacacattgactagaacttccagtactatttggaatgagagtgttaagagtggacatccttgccttgttcctggttatagcggaaaagtgttcagtcttttatcattaagtataacactagctgtaggtttttgtagatgctctttataaagttgatgaagttactatttctttatttctaagagtttttatcatgaataggtattcaattttgtcaaatacttttctgcatcaattgatataatcatgtgattatacattcctcttctttagcctgttaatatggtggattatattgattgatttttcaatatctaaccagtcttacatccctataataaatgccactgagtcacggtgtatcattctcattatataatgttgaattctatttgcgaacactttgttaaagatttttgcctctatgttcatggggcatactggtctgtagttttcttttgtactattttagtctgggtttggcatcaatatagtgttaacaacataaaatgaattggaaagtgcttcttttctggatgatattgaaattgtgtagaattggtgttaatgcttctttatatgtttgtcagaattcttcagtgacttttctgatactccaactccccttccagatcttactgccccaactcctcccacaattatgcaaggtctgaagtctataataaatttcttagtccataatactcatagtttctgcttccctgattgaaccctgataccttaaaatcatttgctattacagtggaataatagttaacatttactaagtacttaaaacatgccaagcactttacaattgttatttcatgtaagtaatcccattaagaaagtgatattgtcccctcaactttacagaaaagaaaactgaagtacagagaagttaagtaagctgtgaacagtcacacagtagggatcagaagcaggacagaaatcaaactcttagccaggctgtctactaacgttctttctcttgacctctaatttctctcagaagaccagagcctatggtgctgatacgatagaaggcatagatttgagcctggatcccattcatcgtttctggtataacctgtgcttttcattttgtttgctttccctttataccctcctgccgtttcccttcttttcgttatctcttcttttctctgctcattgaggatgtttcctctggactttttccccgtcgaacccctccccccaccttcctatcaccttttatactattggaaagtgaatcagacccacaggtgtgtgttcttccagattcgctggccctcatatcatgaagcaccagcgtaagaacaagggcaagccctggctagggaggtggctggacggatatgcagtgcactaaacagaaggggcgttcgttacagcaagagcaagggcagcagacacacacctgctggaaaccagaagaaaatggtccgcagtgactctgagaaattacctttcttgttctgactcctttttttgctcactttggggtcagtgaacttatttattaaaacgtctaccatgccttaagaaacagcattaatgcattaaaataaacaatactgtggatgcagaaatgaacatttaagtggatgcaaaccagatccattccattttgagtgtgtgtgtatttctgtattttttttctcctaagtgcctttgcttagtaaaagccatcaaatattactgggaattattactaatttgtaaacagtcctgaagaattaaagggagagagaaagggaatgagtaagtggaagaaagagagaaagagagagagagagggagagagaggttaagctcaaaggcagagagagcgaaatggaccagattatacaaaattaaaaagcaaatacgaggagacaatttgtgccgagtgattgcaagcaattacagtccggctcttctggagggaagatgggggagggggttatttcagcttaaaaggagactttattcattcctgatcagcttctccaaccattctctcttttattcttggatatcaatttaagaaaaaaaaaaaaaagtcagctttcagatgttacatgttcacccctgtgaatccagccctgggcagacagtgagaatttaagcttccaatcggttctttctatagccctgaaaaccaatttgttcataaagaataaaataaggggcgggggggagaggggaaaacacaacacgagcatgtgtttcttttagaggagagcttcaattttactataattgtctaaagacggagctgctttgatctgaagaattattattgtgcctcaaatgccggctgccaatgtcacagctgtgctggggctcggtcacgccaaggggcttggggtccaacttagtcccagacccgcctttgggtccttctctctttatcgttcctttgtcaaatgggaaagttcattttcctagtatgtccattgaccatcgaaggctatggcatggttgatgttgtacaggtcccttggaaggcctggacacatggtggtgacatcacaggggcccaccaaggctgggcgggaggggagagcctcgccttcacatgggcaggcaggctggatgtgcacatgccctaagcaggctggcacgatcattagatgagaggacccggcacaccggccagctgctcttgctcatctgtgtctcctcaactcatgctcgaggtcagaaatggtctcggtacttgagagagacacagcggacccttcagcacacttccctgatttcaaggcttggagttcatagttattatccctcactccagcccgtgctgcgccaaagcagaggacagctcaaaacacagaattaaacatgtttctttcagacgcagaatggctaaaatctagatggagggtctgagggctaagccaagtcttcagggcgtgtattttccttctcatggctgaggaatagaccaggggaatctcttctgtatcacttccttggtgggccaggcaggagggacctgtccaccctcatctcacatcccgccacctcgaaagctgcctcgcccgtctcctcctggtgcctctgaggtctcactggagactggaacgtcctccttacctgctccttctccggttccccatcacctacagcatcgtccacactctctagctcagcattcaaggctctgcaggtaagctgccctgcccagtcctgctgccctgcctagtcctgcaccccaggtgaggagcccctctgctgtttcagaacacatcatcgaatgctcagctctgggtctttgcttacgtcttccccctacctggaatacaactgcttccttttctccttgtcccttgagttcttctctcctttcttggctccgcttctaactcaaaatacagatcaggtggataagaaaatgaattactctgaatggactgtgagactaagttccaggggcagagctatctaaacagcccaggttatagtctaggaggccgtgacagtaaggagatgacaggctgcgagggacaacccccactcccaccccaccccctcacctctaagccacggtttctcaaactggaagaatgcacagagctcttcacaaagaaaatgtggtaaaacacaagaatgtcggtgaacccttggggtctgaagattccagtatgaaaaacattgtcataggaaacaaacaaaaacccagcagcatgaaaacatgaacttaattatagctctacaaagcaggaggcccacattctgcacagaaatcattcttttcaatcgcatgaaaaaaaaaaatgcacctaggccaggcacggtggctcatgcctgtaatcccagcactttgggaggccaaggcagttggatccattgagcccaggagttcggtaccagcctgggcaacatgggaaaaccctgtctctacaaaaaagtaggaaaattatctgggcatggtagtacacacctgtggtcccagccactttggagactgaggtgggaggatcacttgatctcaggagatggggttgcagtaagctgtgattgcaccactgcgctccagcttgggtaacagagtgagaccctgtttcaaaaccaccatcaccatcaccaccaaaaccccacatctagaagacttttattacctaggcaagcttgatttagttacttaatttctctatgcctcagttttcttatccggaaaagggaaaaaaaatagctgatctggaagggtgggtgcggggataaaatgatggagcatgcatgtgtgcacagtacttagatgactcctggcacattctctgttctcaacccatggcagtgttcatcaaactaaccccagtaggcacctatgttgttactagaaagctcagggacctaatcctgagtagatatctcatttcctcttcagagctaggagatctcatattctgaaatttttagaatgtgggaaggaggatgttcaggagactggggctttgatgagggctgagttgcaaccacagggaacactaagaaagatgacacagagcaaagcatgagctttgagcaaagaggaggcgaactgatttttttagggtaacaaaggttgagcgtgacagacctgacatgtctggccagctgccctaaggatgggacaaagggaggaaggctatgctgcagagctttgtagaggaagagctacttgaggagaaggaatggagttgttataaagattctggctaaagggaactgagtgatctttgcatctcaagaagtcataaaaatgggatgaatcaggagtcaggaaaagagagggagacctatggagctcacggaaacgtagagaacagccttggagcatcttgaagaggagagagaatggaagcaagatagctccaaaagaatgtctctgtcttactttggttgccacttccattaactgcccaataacttcaggtgttggaatagacaagagaagccctacctatgtggactctaggtcacaattcttggctccacagctcctgctctccttacttgcagggaaatgggggttgaacagaaacaaagaagaaagtgtagaaatgaacaagatgtaggtagcagggaagtattcagggggtagtgcaccgacaggcacaatttaccttgaaatacaataaaaataaaagctggattgacaggcagagggacaaacagatgggcagattgtgataaatcaagtatattccattgttaacaattgaacgtaggtggtgagtgtatgggtattcactgaaaagttttattttgttttgttttaacttctctatatgtatgaaaatgttcataatagaaaattgaaaaaaagttaggaaacagattcaagatcatcaaccctcgtcctcattggccctgagacaaattatcccaaaagagcagctggcagaatggtgaaggaatagatttttgtctgctcttcctgctgacttccagctcctcagtgctgtctgtctacctttctggggctgggtaacctgctaagaacaatgcttgtaaggatttaagctatgaacccagcctgtggaatctgtaatttatcagagctctcctaaaggctgatgcaagtctttaatgcccaatgaaatagatcttcagaagtggaattttggccagtggagaagaaactttaggtggtgcatcagttgggattagatttggttacaaatgtcagacagtcccaaacaactgacttaaacaagatggaagctcatttcatgctcacatcaaccaagtccaaatggaagtggcccaaaatgctgtcctcaaacatctcaagaactctggtcctttcctgctcatcgcccacacctctaaggacagtcctcagcctcctggcccaggatgactgtccccatcttccaggcagcaggatgatggaaggaagaaagaagggggcaacagcatgcacaagccaccccttaaggacggttcctggaaactgacatacgggcttagtcacatcttcacacccagctgcaagggaggctggaatatgtagtccttattctttgcaataatgtgcctagcaggaaaaaaattagctaggcgtggtggctcacacctgtagtcccagcactttgggaggcccagacaggtggatcacttgaggtcaagagtttgagaccagcctggccaacatggcgaaaccccatccctcctaaaaatacaaaatattagccaggtgtggtgggacatgcctgtaatcccagcttcttggaaggctgaagtatgagaatcatttgagccctggaggcagacattgcagtgagccgagattgcaccactgcacaaagaaaaaattatactactatgaaaaaagggagaaaagatttgggaggagaaaagatttgggaggagaaaagatttgagtttttctcaaaagtcaggagagtgtctccctagaatgctccaatcacaaatgcacagttttctacattatcttcatatagggtcagctctgactttatcaactggcctctaccacaatggtctcctttctggattgactgcataatgaggaggagaaggaaagaagaagctgtgtgataagtgctttagaatttaacaagcaaagttgtaaggtaggtagtagcatcctcatgatagagataagaactggaggcttccaacaattcaaaagactggtaaggtccttatctgtagaggccactgttaaaatgcaggaggatgcagagtggggctccccagtctttcccaccacccagcccctcgaccttgatagataatctgaaccttggaaaggacagaggctgctggagagccaagaaatcctagacaagggatctcacctggaggggagaacaagcaacaaaagctggaatagagcaagagaacactggtccaagagaacttcagggaagcagcaagcgaacatagagccaagaagggccagacaaggttccttgaagagctgggggctcttggaggatgatgaacaggggtgcggtggggagaggggaacattgtcaaagggaggtgtgcagggcagaacagagcacctgtatatgtactgccatcttggatctactctaaggattagaatatgagttctgcaggttctcaaagaattctatgttaacctggtgtcactgtcttcttgagcagaagttctcaaagctgatgcccattgaaatcacctgggtcttttaaaaacatcctggtacctagtcccaacctccaatatatatatatattttttttgagacagaatctcactctgtcacccaggctggagtgcagtggcgtgatctcgactcactgcaacctctgctgcccaggttcaagtgattctcctgcctcagtctcccaagtagctgggattacaggctcctgacaccactcccagctaatttttgtatttttagtagagatggggtttcaccatcttggtcagcctggtctcgaactcctgacctcgtgatgcacccgcctcagcctcccaaagtgctgggattacaggcataagccactgtgcccagcctcaagatttttattttattggtctggggtgaagcttgggcattgggatttttcagaactcccaacatgattctaatgtgcggaaaagctggagaatcactgctccagaatgatagtcttccaactctaatgtgtatattcatcaccttgggagggcaccgaaatgcagattcttattcatgaggtccaggatggggcctaagactctgcattttaataacttcccaggggatgacaataccgcccatcttgggaacacactctgagtagcgagtttgacgctttcatttctcctgctaatgtacacttttcctatattcacgggggcttcaacgcatcatctacttatgcaaagctgtctcgtcctgtaataagcaagcccgtcccggacagaaacccaggccatgtcctataataagtaagaccatcccagacagaaatccagacagtcctggtctgtatctgccttcacgtttagcgtgttgtctgctaaaccgttgatctagagtgtcccatgttgagcacagcagaaagcacaccactagtgcttaacacagcttttattaatattaataattaatgcttagtgctaatgagtaaccaattaccaatagtaataatgtcatcgagaaaacagtgatagtcctacaaggcacaaacctttctgcttcgtcccccacaccccaaattatagttctaaatgagcttccagaatcttgtgacaggtacaacctcacacgcattcatgtaataagacagctctatggagtgaaattccactttcaacagatacattttcagcgtggcacacaggaaattaaatgtgaaagtatcattaacatggaagttgtgagtttaattccctacacagggtgctgaaaaactgagattgtttatctatacctcatcacggctacctgtttcctgggggatccagtcaatttcttagaatataaactctcttaccccttttttgggtgaacatctactcttcatttctatcctcaaagatccatattctcagaaggcaaagaagtgaatgtgagcatctcactaagaagaacaggattctacagtgtggtttgagattgctaaggatggcattcagggctgattcaggacatgatttttttttctttaaatatttctctttagaggaagtaatgtagcacttaatgtctaatgacatctattcaggaattcatcaaagaaaagctgataacaagatgcgttatcatagtcaacaattaatggtgccgtgtaggaatcttgattgctcttaggatgtgtaactggtacagcttttgctcttgggctgtttttacaaaaaggcaagtggagcacagatgtacctttccgaggtgatcgaccatagtgattgaccatgcaccactgcaagtcatagctaaagagattagccaaggtaggctattcatgccctacattggttacatgtgggcatgtaaccaatctagtttgtgaatctctttctttttctttctttttttttttagacagaatttcactcttgtcgcccaggctgaagtgcaatggtgcaatcttggctcactgcaacctccacctcccaggttcaagtgattctcctgcctcagcctcccaagtagttgggattacaggcgtgagccactgcacctggccatgaatctctttctttctaaacatcattcatcttcagttttacccttcactgcacatccaactgacttgggtgagaggagtaaaaggagggctcaggggaccctttaggggtcaggataccctcaaggactaggtcaaaaggaattacaggaaaagaattttattgacaatctcacttgagaagaactcacataaaggagactcaagtatctcttttcctcttgctggaaaaggagaaaatgaggaagctgcttgaatctttagggttagtcttagcctggaaaaaaccctgcagcattctgagacatctgagaggagctagcatttcaaacaggagcaagcccgctgcatggtggtgatcctcctccccactttctgatcctgacaaggtgatgctcaattgatccagtgccctgagcacctcagaacctcctcttcctccccacggactcatttctgaggctggttcacttcacctggagaagcctatcattcctcctaatagtcttttggttttgatttaaagatctactgaatgttagaaccaaaagggtcttaaaccaacttctacccccaagttccttattttacagatgagaaaacacccagggagaattatcaaaagccccacagccgcctggaacatgagcccatgttttcagactctcaggtcaggattctactttttaaatcttaaaaaaaaaaaaaaaaaaacagcatatctaaagtcccaaagacatagctcttggattctcttgcccatggtggcacgatgtgaagtcacacttagctggcttggtaaaactaagaaactcagtactggcaggctgttgcccatgctggattttgatgaagccacaaagcttcaagttcactgccaaaaagctccaccacattggaagagagaattttctacttcaccagtgggaagtgggagaaatagcctcttgagttttggatggatcatgagtgcctgagtcaggagggtattattctatttaccactccagactcacccttcattttccctccttctccgtcctaccgtctgtgccatgagactggcctctccagactgcatcacctagatttgcttgtcttcagctgggtttggccaatgggaaggcccagaaggaggtcagcgatcaggggattggttagtccagctccttcctgcctcaccatggtttgggcagtagctgtgtccctttccctgtggtcacagctcctggcacaccacctctctccctcagctgcaggtctcgcccagcccagaagcatggttccttctattgccaccttggtccactgagggatttcatcatctcttgtcaattcccattaccctttcacctccataaattgtcccattattaaactctctttgttaaactaacacattgagtgtgctgtcttttttttttttttgccaggaccctgactagtacaggggcccctggatgaagatgtatcaggtataagatgggctgggcacagtggctcatgcctctattcccaccactttgggaggctgaggtaggaggatcacttgggcttaggatctcaagaccagcctgggcaacatagcaagaccctatctctacaaaaaatacaaaaattaggcgtgatggtgtgtgtctgtggttccagctactcaggatgctgaggtgggagggtcacttgagcccaggaggctgaggctgcagtgagctatgattgtgtcatggcactccagccctggagacagagcgagactgtctcaaagcaaaaaaaaaaaaaaaaaacaaaaaaaaaaaaaacaaaataataagctatgtgagctgacttgtgtatggaatcattccatttgaatgggaggggaggcgaaaataaggtaggagacatatgagaaaaccaacagcagttggcaaaatctgcccaacgcttgagagtcctggcctatgtttgatcgactcattcgaattatatgagaccagagtagaatcacagggctccacttcggtgccacccactgacttattccgtggaattgggtgggttcctgcttccacctctctgaagcagctgtatgattctgttcccttgcacacctgctgaaaagaacatgttgctacctgcaatatccaaactctaccatctcatggtaagctgtcttaaatgctaaaacaaacacaaattgaactggttttcccatctgtttctttaacaaatgggagcttaagcccatagggaaactgtgtgggtcagggaagcatcaaatgaacacttctgaataaaaacaaatgtttctgaagatcgcaagatattttaaacagagcactccgttggccaggcctgctcccttctgatgcctgcacaagatcccgatgacagcattatttgcttgaattggatttgtttctgtgcccagaaacaacacacaaggaacctgagataggaaatggctactgggtcctaaaagtcttcccaggacactgtctgagaccagacaggaatgaaacaagagttggaaaccacaccaaaggaaattctttggggtctggattctcgctcttttttatttatttatttatttatttattgagacagagtctcgctctctctcactctgtcacccaggctggagtgcagtggcatgatctcagctcactgcaacctccacctcccaggctcaagtgattctcatgcctcagcctcccgagtagcagggatcacaggtgtgtgccaccacgcccagctaatttttgcatttctagtagagatggaggtttcaccatattggccaggccggtctcgaactcctgacctcaggtgatccacccaccttggcctcccaaagtgctgggattacaggcatgagccaccgcacccagcctcttcttttactattaaaaaatatcaaaagcagagagcatttgcttgcatttttatataaaactccaacaggtgaactagcattcccagaggaggaggaggaagcagtggtgggggtggcagtggaggcagcagcttgactcaagcggagaacctggcatcagccccctgagttttctttagtcccctcttacaagcagatgctcctctgggtcccctccaggtctccatcccagctggcagcttccttgccctgctctggaactagactatacacaccctgactttagtctcattccattttgcacatcaccagtgcctaagaaagtgcttggcacatagtaaatgctcaacaaatgcttcgtggttggttatgtcgattaacctatgaatgatggagccagcgggtaagagatgagtgggtaaaggaaagaatcaaccattgacagtactgtctctctagttgatacattatttctttccaaatggggctgggaggagtgggtgggtaattgccaccagagggaccctgtatgatgaggtcactgggccattttcagggattcactactgtctcttgggattcctcatcctgtctccctccctctgtcttcctgccttccctctgctctctgactcttcgatccatttcttaattctttttgctgagtagttcttcagtttttatttctgttatagggaggccactctcacatttttgagaataaaagatagcgctgggaataatcaaaattacgtaatttaaaatattagcgtattcaccaatacactgactttacgatattcgtggacttacaaaataattttatttaaaacctagtttcaaaaataaaattccttctaccaaataaatgtaacatatatctgtttccatgaaagcaaaatgaaaataatttatcttattgaatctcttatttgaatgctaaacaataccgttagcagaacaatactgtttagcatgtattttatttttttgtcatatctatttctaatattattatatcatggtatttgcctaaaggatgtatattttaaacattattttttaatctttttttcataaagttgcatatcatatactcttcctcaaagttgcactttaatgctttttgaagtattacatataaaaagtactaaagttgcattttgttgttaataaatttgaaactgttaacttcctcaattgaatgttactgaagattataataacatttctaattgagaaaatactttctccaaagttactgagatgtcttataaattcagagcaaactctgctagagtatattccaattttctattttttcagattaaaatatataaatactttagcccaaatattttctcatatactgtctttttacctcccaagcactttggcaggtatttttaaagggaaaaactctttagataagttgtctcaacttatgattccaaatcataggtctttccatttcattccattgaataaaaatataaatgtatccaaataaaaacagaaatatcaaaagattcttcccagaggttaaggtattccaaaaagaaatcgtaattttgaacaggaaatcttgcataatttttgaactctcaacttttaatttgttcggttcttttctttctgttatagggataacgttcattgttttcctgtttgcaagcttcattttcaacagttgcaactagctaaatattttaacataaagtttttttgagcactctattcttttgagattttgattaaatatatccaactggtgttgaataaaagctaaatattttaacgtaaagtttttttgagcactctattctttcgagattttgattaaatatatccaactggtgttgaataaaatataaccacaatttacagatttatttataaaagaagttcaaaaccactgcagaacgtgtaggttgatttacaaagaaactcttcaaaggtgcaaactcttgaaaaactccattgatggcaagcagcaaaaagataaaaagtccacactgccacactaaagtattttttaatattcaacatcaacttcatcacaagaatattgtggcttgattgctctaatggagtatacacaaatatttgtaaatttaaaccactacaatttttaattgatttaacattgcagcaagtgggaggaagctgtgaattatatgaacaccaaaacaaattccaaacctatttctgtctcataagtttcttaattttatattgacattgctttttaccatgaatttgtgcttcaccaaagtttgggtgggtgttatcaccacaaaatttagtaacttcattttcaatgttaaactaacaagttcattaaaaaatggagtattactagtattaacaataagtcagatgtttcaccttctttagaatgaactttcagaaattttaataatttgatttcctgaagtggaagtgaaaatttgaaccaattattaaaacttatgcattttctttgtgaagtctccaatagcactgataaaacagatagcctttaaactgtttgcaatttttcttctgtctcaaatgccaatacattaagtgtaggcactacatgttttgcacctgcataacaaaaacttggaagaaaaaaattttagaaatttagcaaagaaacagtcatttgataacaatgaaaaatcatgctttgtagaagaatctgtaagcccacctgctacagattcacatgtgaattcatctataggaaagtcttcttaaaataactaccgatttttaaaattaaatgctgatattctgttagcaaatcttgttttctgtgtggtcatctgccacaataaatggtaaatattgataaacatttttgtgcaagttacatgtacattggctttcgtgagtaaggaaattcagtacctaatttttcattaaacatgtacatgtggtttttggagctgatggctgccaaaagggattacttcaaaataaaaatgttaccaaataataaaatcaatagttgcaaatgtcaattatataataaatgcaaaactggtattgtaagagcattcagactattctatgttctatggtggggctgctcagcctctgtgtcctgcatggaccaatattttcctgcacacctaccctctggtttccacagttcccgcggaccctgccaacaggcatcatggtggcaggctgcacaccacgggccccagcactctgcactggtagccggtagggcagcagcagtcacttctcacctggagaacctggctgatctcacgtgcttatatctgggtacacttcacatcccttgagaatggggtgtcagttaccttgtgtctggaacagagtaacaaaagggcttgggtatcactggtcgtctttcaaacctgaccacaagttcaaaggagaactctgaactagcatctcacacacagctatataagatcttggcaggagctggtggaacaaaaagcagctctctctacctacccctcctggcttattttgttgttgtttttgttgtcttcttttttaaaaattgagtcagaggctgggcgcagtgactcatgcctgtaatcccagcactttgggaggccgaggcgggcggatcacgaggtcaagagatcgagaacatcctggccaacatggtgaaaccccgtctctactaaaaatacaaaacctagctgggcgtggtggtcctgcagtcccagctactcgggaggctgaggcaggagaatggcttgaatccaggaggcggaggtggcagtgagccgagattgcgccactgcactccagcctggtgacagagcgagactccatctcaaaaaaaaaaaaaaaaaaaaagtcagaattaggtactaaaagccatatgacatgcctgaacagggacttgaaccctggaccctcagattaaaagtctgatgctctaccaactgagctatccaggcttcttccctgctagtttattttaatgcagtaataaataacagcactttgttaaaaataataaaggtataatctgtgacacatccaaagtggacaagatgaagagataataggtatacaccaggattcccctgggcaaactgggacctcttggtaccctatatattaagagtctcgggttttgttttcacttaagcaaatgtccaaactttcttatccttttctcttcaaagtgttttcctatgtgcccatcccttaggacttctagctcttgtataaacagataattgaggtgcaaatatctgatagggtgtcgtacaggatgattgcaaatcccatctgattaaggtcacagaccactccccagataaaacccagactcaagctgggcgcggtggctccagcctgtaatcccagcactttgggaggcccaggcaggaggatcacaaggtcaggagttcgagaccagcctggccagcatggtgaaaccctgtctcaactaaaaatacaaaaaattagccaggcatggtggtgcgcgcctgtaatcccagctactcaggaggctgaggccggggaattgcttgaacccgggaggcagatgttgcagtgagccgagatcatgccactgcactccagcctgggcaagagagcaagactccatctcaaaaacaaaacaaaacaaaaccagactcacccctcccttgttgtaaaagactgtgctagagcctgcagagtggttctgccctatccaccctcccttccttaccaatgacatgagcttgaagatggaagccacctgttcaagagagatgttcagaaaaataagtgttgctaatgactggggagctgccatatttattcattaccaacctccagacccagcagctgattgcaattcttgacctaaacaattacacattgctgaagttcttgcttcccattccaggctcttctgcctccactctgtccttgcaccccaaacccctgccatacaagtcacgaaactcattccactcatccttcatccatgctattaccttggctggagatacctttctcagccttgacatccagctacttctgcccttctgccagaaacaaacgtagtcatcacctcctcctggaagcctctctgggctgcactcctgagacatcccaggcatgctcctgcactctgttatatgatcacctgttaacacgcctgcctccttcaacctgtgatcagcttgagggagggcactgtgtgttctttcttcctcagtctgtcatcctgtgtcaccatgcctcctatatggtgacatagcaggcatatgtaatgggaaatgattgaatgaatgttgaaactcaccaaataggggagggtcctggaaagcctctgggaggaggatacctgattggcctgtaaaggtaggggtcacaatgtggcagttacacattctccatcaataggatcaggtccattatcctattaaacctccttggggaccttgagggtgagaggacatgcctattagtaacccccgtttatggctgggcaaatggaggcatggggaggttaaaagctccgggtcaacccaggagttggtgatgaacctgctgtgattggcagtcgtggggacctgatgccggttttgttctctgaacctcactactttcaaggactcctcagttcattctctcaatctctttctttttgttttcttttttcctccagtaatatccaaaaagtcccttctccagattaaatcgtcctggcttcagatatctaaagcagctattttttttttttccttcagcatttgaaatgtttttaagggtttatttcaaacacccttttctttgaactgattgttcagaactttcattccactttgtcagtgtgtttggtagtaggctccgattcctaaaaggtttttatttcttctctattagcggccaccacctgcttactgtttggatgggttttgctttattttctttgctttcatctattgaaatggatgagaggaaccttaggtaatgaaccttgtttccagttttccccctcacctcccctatttttaactcctcctgccactgctaaggatgaggcaaaggacgaaaagttcctgggtggtaagtctctgggagtcactctgcttttctccccaggtgtggggatggagtggcaggcagcagagggcagaatgtgcctggaatgtttgcagtgctgttggctttgcaattgcctggccatcctgtttccccacagcaggatgcatggtggccttctaaacggccactctggctggagtgaagaggtgtctttctccaatcttacagggacccctaagcttcatggggagatgtgagtgtcagtagctgttgctgaggcccacattgccagacactagcttgttccatttttggtttatctacacacattggcccttatgggagcagcctcacatataaatatataaatattttaccagttcatcctgccctcagggtatcaagtttaatgaactaaatagcctccattaatcacccaacagaatgttatttacttcaagggaaagggtaagtggcctctgcaaagacacgtcaaggactcggtctcggcaactcttctctgtgctaggtcttcccaaatctttaagaacaaagtcctaaatcccgggctgggtgtggtggctcacacctgtaatcccagaactttgaggggctgaggcaggtagatcacttgaggtcaggtttgagaccagcccggccaacatggagaaaccctgactctattaaaaatacaaaaattagctaggcatggtggtacccacctgtaatcccagctacttggaaggctgagacaggagaatcacttgaatccaggaggtggaggctgcagtgagctgagatcgcatcactgcactccagcctgggcaacagagtgagactccatctcaaaaaaaaaaaaagaacaaagtcctaaatccagaagttctgccagccaagttgacacattgctttcctgtcctctcttctccccttaccaaattttagtattactttttaattaattaaataattaaagagggtctcactctattgctcaggtggagtgcagtgctatgatcacggcttactgcagcctcaaactcttggtctcaggtgatcccccctaccccaacctccagagtagctgggaccacaggtgcatgccagccatgcctggttaatgtgcgtggtgttgtttttttgttgttgtttgtttgtttgtttgtttttgtttgtttgtttgtttgtttttgtagagatagggtctcactatgttgcccgagctggtctcaaactcttggcctcaagtgatcctcccacctctgcctctcaaagtcctgggattacaggcatgagtcaatgtgcccagcttgcctaccacattttagatgtcagtttcttcacccttttgtttaaaatacggcatactctcccatatctgcccagcccagaaatgcacggtcatgggttatgtcagcccagggagggtgagaaaggtcttgagccctgttgtcatgatgaccccatagccaataaatcaagtccagtgtaagtaacatttgagcaactggagaaaatggaactgaagtgggtacatatcagaggccctttgacatctctgaatatcctttgtaaataatatctattgcccagcttagagctgtgagagccactcagcgcaagtgtatacgagtggaaaaatgaaggaaagggaagggcagagggaagggagtggagattggtgctgagacacagggggtggccttgggagctgatacagcagtgcctgtgttaagctaggctgtccatcctttggcaccccagtccctactcctgcagccacagatgaaaggcaaattttgcaagccaacatctaccttgccccttcctaggaacagtgaggtcctatccattctgatcccactgaaatctaagagaattggtggagatctgctatcccagcccagaaaatggcatcacgtgtgaggatcggcccttcacatcccttcttttgcagggctgaccaccgcctcacccactccctgctagaggggtccggcccctccctgcacacatccagactctccaaagcatcttgcatttggccagaggtctcgggaagcctctccaggctgtgtagggctttagcccaacactaattagtaatgcaatcccgcaaagagtgaagctgcctgccacctcccctcactcatagtgatttatgttcaatttgtacaaatggagaaaatgagatttcaaatttcaatgccatttctgcaatgaggtgattaaaagagagagaggtatcgccttccactgtatagaatattgatcccagtgctattttcctttgcaataaccattagctcagtattatttgcaaacctctaatgtgaacctggagatgtaatttacatttgtgcctcacttattcgctttaacaaaacaacacaaaagctttggatctttcaatctatccatattgtcaataaaattagcagcttgaagggaaaaaattatattcaaaaccataacttcccattaactaccgcaagacacaacacatcgttgcaaaagagagagagcttcgtagctaaatcctttcttgttctttcttttcctccgctccctcttccccctccatggggttagaattcaatgaacaaacttgaaagtgaaacatcccctcctctgaatgtggatcagcttagggtctgggggctggctgtgcacatctgaggcccgatccctccgagggtgaccccggaggaagagaacgcgtgggcccctgctccaagtgccagcgcacgcctggcccagaggtccatcgggctgccaggacaaatgcgtacgcatagacacgtgcacggagcctccgagagagagcgagagaccaagagcgagcgagtgagagacagagagagagagaaagagagagagagagagagttcctcaagagagccgggagccagggtagggaccaaaagggctggaagaaaagatgagaaggaggtaatcaagaaataaaagcatgggggctgtgctctgccaattcaaatggcagttccgtcagcctcgacgctgaacaaataggccacgtagctccgcgttctcatttcttgtctctgcaaatccgtcagctgcctacaagggcctaccagaccctggaagacgagaacaagaaaaagggagagtggggggcgggggagctaatgacccataattgccatgatagtgggagaggggccaagcagctgttttacattcctggtatgtatagtatgcaaatatcgacaaaggctcgacacagtttcgctattgtggatccggagggtaaccaaattagcctttggcagccatggtaattgggaggtgctgttcccattaggagtcctgcaaattatgaagaaaaatggaccgagggctttgtcacaaataataataccaagaagaaaagcgcaggcggctgtcttttcttttcttcccctgttccccaccctctgcctttgttttttttttttttttttttaatttctgcattgtgttgttaatacctctccatttagtaataagaaaacagtctgaaatcccccactagacagtgcacggacttgattgcaagaatgtcaagtttgcaggagggtccggggggaagagctgctttctgttgcccgagcccaggggctgcaggtaggaaaggcgcagttgtgcagcagtaaagacttcccgcccagagtcctaggtgaagagagaagcctaaaaactgacgtctcaaagaaaacgctctttccacgaagcatcttctccgtattgtaagggtgcagagaacatctcttcctggagcatagctgggctttatcctccacctcactcccaaagagtctaaagttctggcttgattgaggctctaatctcttaacaattcagacatgggcttgaaaaacctccagtcatgatgcattaagccccgaactcatgccgaaaaggtttgcagactttcgcccttggcattcccttgagatggcctaattccatgtccctgggagctgggtgcctggtgaccagatgggccaccggcatatcagatgacgctatgatgagctcagccctttgtggggcatgagtaaatgaggcagaatggtccgttcggggccaagtttgccccagaggagagacacagtatcaccacggtagcagggaactgtgatgcctacagtgcatacccatgtgaggagtaaaggaccaatacttcccaaagcattctctcctttaaaacaatcaacttccattttcctatgttttagcatctgttggtttggccagaggaacaccttcgatgagaaggggctctctggaaatacgatgtctttcatctatgttcctccagttacataggaacatctcatgcatggttcgcattttatttttacattgtatttcatacaaatgtacaatgttaaaacacagaaaggaatataaatctacttggataactgaaaggatactaccacatactcgcctttagaaccagacagaatttcccataaggaaaaaaaaaaatggaattttcataaggtttgaagtgtcctcagagacacgactataaaaggatactgccaattttgtcctccaaagggtaaagaaagaagtaatggctagttgcatgcatttgggaaattaacaaaaataggaggaggactgaaaatagatcaggtcatagcaaagtcaaatagagggttgaaaaatgagtaagaggaaacggcaacttgcttgcacaatgtcagtgcaggtgggaccaatgggtgacttcaggaatggagtgaggaggaaaatagccaaccatgatactggtttctttcctttgtgtaatgtccaaatcccatttcagtagacaagggaatactggcccccattccttgctagttttaaatgaagaacattcagctgtttagatacagtccaggtttcaagtctgtttcaaggtaaatttgagggtgagggagaaaaaaaaaaaaaaaaaaaaaaactttctagcatttacaataatttttcttaagaaaaaaatattctttgatgaaaatactctaccatttggggactgtgtttaggtttttgttctaggtccaccccttgacatgctgataagggctgcagtgtccagtaccctgctcgacctttctctcttcccttctcagagttccagccacactaagtgtctttctgtgtgtgttgaacccagtatgctttttctcatctcttattttcacacaagctactccctctgcccgctggatgtccctgtgtactgccctaccatgtgacacaggtctgcacacatcccttgggctggctcatcctcatcctcttcctcaggtcactgcttagatactacttcccccacacagccttccagccttgtctgactttcttagtctgggtgaaaactcctcctaccatctgctctcaagtgcctagtgccggaacttatgacagaattttctgtctaatcacttttccaaggctgtgagcaacaggagagcagggaccacctctcttgttcatcaatgtgtcccaagttcctagcccagtgtctggcacatagcagttgagccataaacatatgttgagtgaatgtcatctgattattcagaagcttaattgagggcctaaagtattgaggcagcagaatgggtctgaaggcggggaacataaggctgattcatgctgacttcctagaactaaatcaaatggattcgattcagctatgacaggaaatatcctctccatttacacagggcatacacggagtaaatgactttgtaactttacttcatcctcttcatttacataggacatacaccaagtaaccagtggaaacctctagagggtattgaaacaccagaaaattctgtaatggggctcttgagcccctgtgctcaggcctgctcccaccctgtggagtgtactttccttttcaataaatctttgctttgttgcttcattctttccttgctttgtttgtgtgtgtttgttcaattctttgtcaagatgtcaagaacctggacaccctccaccagtaacagtatcacttgataacaggtctctaacacttggcttttgcattgaggaattctgccttcgaggaatacctatcaattccagaatcccagagggtcccccacataaagatagacctgcatttattccaaacaccaaaattaactggatagtgctgggattagaggtgtgatgcagtttttattctagcccaggactttcctggtttcctgctaaatctagggtctctcttgctcatttttttttctcttcaggaatgaagtttgcttttatctgcaaatgttgctaagaaagaatccatcgttcaatgtaccgtggtccactctgcactttagggtctcaggctttacccagaacctggagcaagaccacttcaactcttgcaagaaattcacaggtaacactaaggcaaattctttccactgtaaggccaaggcaatttgggttactgggtatttatatcttaggtatatatgtgttatggcataaaacctgcttggaaaaataagacttataaatggacagcaataacagaactaaaacgatggaaaatggtatgagagattggagttgggtagaagaatagtgttccttatgctgaaatagcttgctatttagaaaaagtgagggtttttgacctggaggaaatggcaaaagactatcaatagggagagtgctagggcagaggattcccgagtggaggttcataaaaaattaagctcggatagggaccacataggtgagagacgttaataacaaatgaaagagtttagttaatggtgggcagcttgggtgtggcgctgtagggtgcagttactcaaatgtcttctgaacccatctcaggaggactcttactaaggtctgttatagcaagggtccaataaatcacacctctctgtatctatgtgattttttttttttttggcagagtctcgatctgttgcccaggctggagtgccagcatgattatggctccttgcagcctcagtctcctgagctcaagtgatcttcccacctcagccttctgagtagctgggaccacaggcacatgccaccatgcccagctaattttttatttttattattttgtagacacgggttctcactgtgttgcccaggctagtcttcaactcctgggctcaagtgatactcacctcagcctcccaaagtgatggaattacaggcgtgagccactgcgctcagctcatgtgatttcttagcctcctcccgcactaactctgggcttggctttgtgagttgttttggctgatgggactttagcaaatgtgatgcaagcagaagtttgaaaagtgctcattcatcggagtttgccttctctggctctttgctgggactccttctagcaccatatgcaaaaagctgagcctagcctgtttgaagatgagaacctacatggaaagagaggtccacctgtcattgctgactcacctgaggtcccagacatctaagcaagcccagccaacatgatgtgatacagaaacgcacccacccaactatgtctagcataaatgttctacctgcagagcagtgagcaactgtatcatttttgttccaagcttctaatttggggggtgatttattcacttggcaataaataactggtacaaggtcctcacaaaaggagcctagaagaatttgagagaacaaatttgctcctttgggagctaatgtaagagctgcaaacactgaagaaagctaaaggaatggtgccatcctttagggctggctgatcagaagtgttgcaataccagggcaggttgagggtagcagccatatgggtggcaaaggaaggagggacagcctactatagtgctgatgaaaagagcaacatggacctgcacggggtggggtaggggtaaaggaaggcgagagtgatggagagaatagcagagcccacatcagcagggacctcatggcccaatggcaggccatggcactgtcagcccatctggagaaaccacagggatatgaaaataggtggtggtattgacacggatggaaacaactggcagatctcaatggctgcctcctgggatcctgggcaaataaacactggggatgggggtgatgttttgattacactgggaaaagcttcaattatcaagtttccctcattccaggcacttgtctgacttaggaagccataggattcctggaaaataaaactgtaggacaagatgtacaaaatccagcaaaagtcgtctgtcatcccagacattacttttctattttcatgaccccattgctattgaagttgaggtccaatatatacccagttgttacgatgctaagacagactggagatgaagagcgtttgttctagaaagaaccaaatgccagcttaaccacccactatttagtgaccctgggcaatttatttaaccttagttttcttcatctgtaaaatggaactaataatagttcctatctcatatggctgttgtgaagattaaatgaaattatacaaagtgtttagcatggtatcagatacatagcaaactcttaaagttgctatgattattttcgatagctatttagaactccagattttctgagcaattcatttggattatcaagaaaaatttcatcatctgaatatcatcagtaccttccgtgatacctaaaatatattaattagggaaaatgccctcttgatcccagcatttgaatctgggagggagagaagataatcctatactttccttatgtttggcattctaatgtattcctgatgaaaatcttgatgcacattcaactgtattggatctttatttttatcccatctgactagcaagttctcattaagatatgatttaagaactgaacgttcattaaaaagatcatttcatgacaaagtgagatgagcaacgtagaaatgattccatagcttctctagatcattccatttagggcttttttccaactgaatccagcataattcatagaagcactaagatttgcctttcgaaggtctggaataattcagcaattaacatcatacactcttattacctgatgcattagatccaaattgcaacaaataccaatgctagcaatttgtttttcctataacttgcttactttaagcagcattatcttggaaatctttcttcttaaattcggttctaagaaaaaatattcacaaataatttatttcaaaataatctctccttactttttttaaagagtagaattatgtagaaaaaaatcagtaacatcactttataaaaagaaacaaaattctgactcagaatgcttaaaacaatttttctctgataggtttttttttctgactgaataaaacaaagctcatagtaattgtaacaacattagcactctttcaagagtggagattagtcactgaaatcttgtgttctacaatgtcaaaatttgtctgaactgcacttcaataaaatcacaaaatgataacagtgtctccattcatgctatataaatatgaaaaacatcaaatcaagtggaaaaacatgagatgtgccatttatataattgttacaaatttctgttgtacaaccaatttctacaaaattccattgcagctattcaaatacttgtggaagaatatcttaaaacctttacatttcacgtcttaaagttaacttaatggaaatactatcagtagacacactgacagttttatcaagaattccgctgcagctcagaatggaggaataacatcagctgcttcatctactgagacatccagttcaaggatcatcacactaactccagtatttccactaacatattcccaaagatgggaagctttccatagtgtttccaaggcaggtttgtgaacttttgcccaattcccattgaaaacgttttaatggcataaaaatattctctcattgttcatgctactaaaaattttattttggtttaaccaatgtggaaattagtttcaaggtggacctgatacgtctgaaataaaaattgaattgctatgttacgtaactccacctttcactgacgcaaccccatttaacaaatccctttgcgttaaaacaataaaataggtcagtgcagtggctcatgcttataatcccagcactttgggaggttgaggcaggcagatagctcgagcccaggagcttgagactagcctgggaaatatggaaaagctccatctctacaaaaaatacaaaaattagccaagcgtggtggcacgtgctatagtcccagctactcaggagggtgaggtggaaggatcacttgaacccaggaggtcgatgctacagtgagccctgatagtgccattgcattccagcctggacaacagaacaagaccctgtctctcaaaatataaataaaataaaacaccgcctctccaatgaaactaagaaactgcagaggtgagagctaactgatatttctttgaatgaatatataatacaatgtcagatttctcctgtgactaatatttatctcattactctgttgggtgcagtttttatatatggttgccatatttctataaagtggatatacctttgacaaaatgtcatcgaaatattcttggtcaccctgctttttacactaatgagatttctattagtcaggataaagttaagctctgctgtggtaacaaataaacccctaaatctcagtggcttgacatatcacatccacacaaaagctgacatgacttaggaagtcctccttcctcttgaagctgagttatctggagtatggccttggctgttattgtgtcgggggcagagagatggaaaaggacctggcttttacctgtttcagcccagaggtgatacatgtcactttctctctccctatccattgactggaattggtcacatggcttcaattcactgcaaaggtgctgcagaaatatcacagagcatgcagatagctggaaagcaccaactgtctgccacaggcattaaaataaacataatgaagctattttgaatacgcttcaaaagatttcaaactgtaggcatgtgacttgtgctaaaccattcagaaatccgtggcatcctcactacttcataacagagtcaatattcattacgtgtgtgtttacatgggtagcactgagtctcattggctggcaaagtggcacaggtgtacatactatggataatatgtgtgcttatagataatgatatggtctaaaatgaaactagtttggtctaactcgttgcttgtcaactagggacaaaattgcacttagcagtgtatagagacatttttgattatcacagctggaggcaagtggtgggggtgtcactgacatctagtaggtaaaggccacggatgctgctaaacatcctaaatgcacaaatcagacacccatctcaactgtgaatcgtcagtgttgttggcccaaattgtcaatgttggtgaagctaagaaactctggtctaccagatgatccaggaaatgctatctccccatcttgcccattgagtgcttttcaacagccagaagcaattgcttcctttcagctgcatattcttgcttccttggtcccttcattgatggttccaaaatctgtatatccaaatgctacatacctatgcagctgtctatcagttacatttatcgagatgtccaaccatctccttacatgaaatctgtgcaaaatgaaattcattgccatctcctgcctctgactccaacctctttcccaccttctttagtgccattggccttcacctttcagtcacccaagctggaaaccttaaacaagccactcctgactcctcccccttcacagttccacacaccacccaattctgtagatttttagctcccacaagacttcggactctgatatccctctctgtctcctttgtttcctcttgtatggctgtgttgactggaatccacgtaaaataataataatggtttactgctattctcctaggaagtatccctaacaccagtctctctccaccctgatccaacttccacattgccaccagggaagctgcatggcagcatagaaaaagtgagggatctagaatcaatagacctacatttcaaacccaggtcttcctgcataacgcatgggatgcaccttaacctcttgaaaccacagatgtaaaatgggactaaaagcctcccccttacaaagtggtcttgaaggttaaatatcacatataaaaatcctccagcctaaaccctggcacgcatggttgctccatatgtttcaccgttatttatctttgtcattattatattgcttctaaagtcacccttaacattaaacaactgcagtttgtaaggattaagttttcattcccaaatgccttaaaccttcaataaactgctcctagcggactgtggtgagactgtaaattctagctggtgaccaaccatgactgtattatttctcactgtaaccactgtgcatcgagtacatagtaggtgctcaataaataaataaatgttaatcaagtgaataataaagtattatatacattttattatatataacatatactgtcataaaagaaatattttgctctatgtataagctggaattattctttcaattttttttttctaatacaatcctttctgaagtctgcccgtatccacctctctctgtaattaatgtctcctctctgttctaactttcagtctgtcttgtgtcacctattttttgcagctggtctcgtctgcttccaacagactatgcatcactttcttgccatgaacctatctggttcccctttatcagtatttcccttactccaatatacacacatatatgcacacagattcacgcacatcagatgaactgacagatttttctcattattcttttttttccagaaacttccatggctacatggccaaccaatttttcacttgtgcatccaggcttgtaagttctatcacataatacactgaaagaaagcttcatgtcacagagaaacagcattcctatccccaagctgactggaggaagacaaaaatttataatccaaatgagtgagatgaagtaaactcagtaatagctagattgggtcagaaatgaacagctgcttccagcatgggcagggccaggctggcccactgtacctgggaaggacaggttcacatggtgcttgggtccagccacacagcagagcagtcctgagctcctagggtcaacctgttccttccttccaaggtctttccctggatctactcaggtaatttcctagctgttgagaagacagtgaactcaaaaaaaccattgttcctgggtgtggcaggctcatgggtgggcacatgcacacacggttgacccttggctagccaaggctttttggatctgagttccccatcttccatgtcatctggcactctgtccccagacctcagagctgctagaatgcacgataaaaagccaaattaaaagttgtatcaagtgcaccctagactgaagaagccatgtggcttttgaaatggcctcacttcctccccagagtggcttctttctttctaccttctccttgaagactccatactggccctgcctaggtctgcatgccttcctccccggtctccctcagggcctcttgaagctggcaggcaaagagtcgcttcccggtaggtgcagttggcacgactgcaagtgtacttaaactttgtgtctgatcaagttatgtgtattggatctgaaaccagttagtcaattcgttcaggtccctaagtggcgatttgtggtaatgtctacatcaatacggacggagcggtttgctagctggtttacgtaaagcaaatggctgcaggaaagagggggcagcctccagcattctctctgctaatgaagatatggctggaaaagaaaggaaagcgagtggaaacaaaagtcggcatccatttgtgcataaacactcaggcgaggtctattttctaggttgaatcaatttgcctcttccatttaccccttgtttcttcctccccattggccttctttccttgttgatgcaccgacctaatcattagtattataatcttgttctgtgtatattaaaactccccaacccagggacaaactatggtgtctgtttgtttgttttgatggaattttttgctcttgttgcccaagctggagtgcaatggtgtgatctcggctcaccgcaacctccgcccacgggttcaagcgattctcctgcctcagcctccagagtagctgggattataggcacgcaccaccatgaccggctaatttttttttttttttatttttagcagagatggggtttctccacgttgatcaggctggtctcgaactcccaacctcaggtgatctgcccaccttggcctgccaaagtgctgggattacaggtgtgagcctctgcgcccggcaaaactacgtgtttaagagggaacctggggcactgatacaagttccactcagagtcttacaggaatgactgaaaccagaaagaaaaaaatgagtggtgttgagttccactcgccttgtttctcttttgtatcaatcgtttctgcatttgccctggcaggggaggaaacagcataacagggaatttatttagtgtgtgtctgcatattggctgtatctctttactgctgcagagtacgttgtttctaataattgtgatggattgatacttatgactggctggcagaattcctttagcatgttaaaatattaccttttattccctgatctaatgcataacctgatgtttcagtcagttttcaaatgtaataaacaatttgaaaagcgaataaccctaaagaaaaggaagatgctctgtatcggaggtgaattccattttaaatcatgccctctgccagccaagtgaactccttagcagagttgttctttagctctgatccagtcaagccatctaggagttggatgcaaacgaaagaaattggtgcacatgaaatagactaaaatctgtctgacaaaaatgctttggctaaaatggaacggctgaaatcctccttgttctggtctgctaagctagccaggaaatagcaaaattccaggctcaaacctgagaaagtgtttcctcgagtatggcttctgccttcacctgctggctggagatttggcccttgaaaatggcagttttgcccttacaatctcacctcaacacgctggtccctaacatccctctggaaattttgcccctgaaaagacgttaaggctcagaagcttaccaccatcacctctgacccagaaacaaatcttaggaccttgacaagacgcccatttgacatggcaaagatggaccaaatggcttagtggccaagtggctaaatgcagacagaacacttcatatccttcccctcatcaatgcacatttctgaaataaacagcttaaaactgcaggtcacatgaatttttatttcattttgttttcttgcattttaatttctattctttcctattgtgggttacatcacttttcatcacggtcgtgctgcagaaacgtagagcacgatttatggagccttaacataaatatgatgctagacagaaagagagcgacatattagtttagaatttgcagactcgcacacacggagcacacatggctgatttatgaaactgagatagcctataaatcctaaagtaaggtgctgcatccataaactcccaaggagcaagaggcagtgccccttagcacaaactccagttggaagcccctaggccctgaaaacaaaagacgcacccaatgcttggccttttgcttttcttagaaacacatcgtggccgggcgtggcggctcacgcctgtaatcccagtactttgggaggccgaggcaggcagatcacttgaggtcaggagtttgagaccagcctggccaatatggtgaaaccccatctctactaaaactacaaaatttagcaaggcatggtggtgcgtgcctgtaatctcagctactctggaggctggggcaggagaatcgcttgaactggggaggcagaggttgcagtgagccaagatcgtgccactgcactccagcctgggagacacagcgagactccatcttaaacaaacaaacaaaaaagaaacacatttttaaaaattagccatataccaaagtggtgggaaggtttgctcttcaccaattaacgaaggatgggtaaggaagttagttggtggttggactctgctctcagattcaaccctccctagccttctattctcctccatattctgtggggcggggcttcccagtgcaaactatatttcccaagagctctcttgccaaatgacttctgcctgggatttgccaaatgggaggcactgggaggagtctggggggtgggagtgagggaggagccaggtaggaggcttcccctcgcctcctccctctgcgttgggtggcctcacaggaagttgctgcttctcctccatgatcccagctttgtcagacagccttcttgtgattccaccttccaacaggtagccctggtttctgggctctgtcccaccatctcctccttttgttccttcaggctgagggtggtcacagcttcctgctgttactagtctctccagtgtctcctcctcccccgccacaccacaccatgcccatccagtgcctaacccttttaaactaaacccatattaactttcctgtagaaagttttatatataggttctgccttcctggccaggacctgactaattcagggggaccctggaggctattccaccatctccgactgacaagcttatggacaaggagcaaaatacaaatctgcttccagctttaaccagtcctcagccactcaaaaactgtctgacaaaatcactgcaaccaccaaagattacacaatagcttgattttctcttcctcttggagaaagactcggttgtgggtctcatgaaatactacttgaggtcaggtgcagtggctcacgcctgtaatcccagcactttgggaggatgaggcaagaggactgcttgagcccaggagtttgagaccagcctgggcaacaaagtgacacccaatctctacaaaaaattttaaaaattagatgggtgtggaagcatatgcctgtagtcccagccactcaggaggctgaggcaggaagatcacttgagcccagggggtcgagactgtagtggacaatgttcacgccactgcactccagcctgggcaacagagcaagaccctgtcttaaaaagataaaagaaaaaagaactggaaactccctgggaatcctgggaacaccagaagaaggaatgggaccaaaggttgaaacgctcccaaagatatgggtagaaaaaggtggagttcttcaatagttgctggagaaaggagaaaggattataaggattacaaggtgatgccttgtaatatgttatcactcttttagaaaacaaaaagttgaatagatccagagcttaaattgcttatcctaattcaacttcaaaatcccagcccaatcactctttcaacctaagttataaataatttgacaacttggtggtgtagcattttgcagccacttctctgcaaactataaatgcctgtaaaataatacatctgtgcaatattaacaatggccattgcttatattttttggtgcttcatgtaaacattgagttgtgagttcctttcttaggcatgctgccttctaaatgtttttatccccttgtaaaagcgtaacagaaatggtgactccccccatcaacactcaccaaattttgaagaccatagatgaaagatagaaacttaaaatatgcaaaatatttgctccaaattaattcacatggatagaggttagaatggtgttggcttttggtagggaaacattgggggacatgtgggagctttctggaatgacggacatgtttgacatcttgatgtcagttggttccgtgagtgtgcgcatgtgtgtatatgtaaaaattaacctgtaagctgtacactcaagacctgcactgtttattatatgtttgcacacatcaatgaaaaatgtcaaaataatcatttttcaaaagacctggaaccttggcccctgaagagttgaagaaggaatttctttatggaaaagcgatagcaacagcatctttttaaagaaggagcatttttatggaatttggcaatcattgtggacacacaagtgaactcagggagtaattattggctagcagagagccaagttcatcaacacctcctgggctggggtaaagggagcaggattgggtagcagaagaagttgaattacggtgcagacaaaaccaaggcctcatctgagccgggagctctcgagctggaatgcaggctgtaccctggggaagggggtttaacctggggcaactactaaaaagaggaccttattgagagcagtcagcctccaatatttccaatagctgggcggggcagggagtgagtgcttcggttctgatgtgggagatggacttggatggtgctggaagattccacaaggtaagaagtgaggaacaggtgccactctcacccataacccattccccaaaatgtgtgaactatgtgtttatgagacctgaagtggggttggactcatgggcaaaactacagaacaagtttatccaaataaagatctcatttagcatcccaggtagcaaggatatggagcctgcaaataccatgcatctaaagagagctggatggcctgtgggagaaactgacaggcatcctctcagtccctcaggtcctttgcctcctctgttgggtcacagacaacaaaagacaatggaagctgcagattcacccacccaaggggcatttccttcagcgccaccatgccagagagagcggcaacttcccacaggttgcaaatgagtccgcgtgatggggacgtgagttaattagtgcacttgggtttgagaggtgggtaacaagctgccgctctgcatttggtggttccttttccgaacaggtggcaactgactgacgggctttctctgaagtggagaaggacatctgtgttttccatattgcggaacaccggatctttccaagtcacacatttgggaagacagctgaattgccttcaagttcctcctgttatggtacaaatacccacctggtgtgcaaacatgagagacgcagctttacactagaaccaatgaaagcaaatttgagaaaacccaactctttaggaatggagactacagatgtatgaggggatcttaataattaaaagaagaaaatatgtaaacaggaaaaatatccaactgtcacaaaactctacactaaatcaaactgcaaagttttgtctttttaaaaatatagtcatgtgccacatgacaacgtttcaatcaaggaggggctgcatacacgacaatggtcctgtaagattacaatggcgctgaaaatttcctatggcccagtcacatcatagctaccaaaacatcactgtgcaaggcactactcatgtgtctgtgatgttgctggtaccaacaaatttactgcactgccagtcatataaaagtataacacatacaattatatacagtacttaatacttgataatggtaatagtgactatgttactgatttacgtatttactataacttgtgtcattattttagagtgtgctccctgtacttacaaaataaaaaatttaactgtacaacagccccaggcaagtcctttaggaggaattccagaagaaagcattgttatcataggagatgacagctccatgcgtgttattgcccctgaagaccttccagtgggagaagatgtgcaggtgaaagacagtgatatcgatgatcctgatcctgtgtaggtctaggcttatgtggtgtttgtgccctacttgggtttttgtttttttgtttgtttgtttgtttgtttgttttttgagagaggggctgactctgtttcccaggctagagtgcagtggtgtgatctccgctcactgcagcctagacctcctgggctcaagcaatccttccacctcagcctcctgagtagctgggactacaggcacatgccaccatgcctggctaatttttctacttttgtagagacaggatttcaccatgctgcccaggctggtctcaaactcctgggctcaagtaatcagcctgccttggcctcccaaagtgctggtattacaggtgtgagccactgcacccaacctgtgccctagtttttattttaaaaagtttaaagagttaaaaaaaaaaaaaagagttttaaaatacaaaaaaaaaaaaaaaaaacctcacagactaaggatataaagaaaatacttttgtatagcttaaacacaatgtgtgttttaagctgtgttattccaaattttttagatagtaagtttataaaggaaaaaagttatagtaagctaaagtgaatatattattgaagaaagaatactgaaattaaatatttattaaatactgtaataaatctaacgtagcctgagtgtacaatgcttacagtctacagtagtgtgcagtaatggcctaggccgtcacactcactcactggcacacctagagcaacttccattcctgcaagctccctttatagtaagggtcctacacaggggtaccactttttaatcttttaaacgatattttgtatataccttttctatatttagatatgcttagatacacaaatgtttaccattgtgttataaatgcctatagtattcactacagtagcatgctgtacaggtttatagcccaggagcaataggctaaaccacatagcctaggcgtgtagtaggctataccatctagatttgtgtaaatacactctacgatcttcacacaatgacaaaattgatgaatgaggcatttcttagaacatatcttcactgttaagtgatacatggttgtacacacactcacgtacagacaatttgagactgtggggcttcgatattaaataagccaactgttttagaagaaaagctaccccagcacatctcaagaaaaaaagcgtaccatacaggctctcccttattctggaacttttaaccagtagcctccctccctactctgaatgtgttttgagtccttatgatttatgggtcaccgtcaataatcaaagccattgctggattgaaactgacaatcagatcaggcatctaaattaaacaggaatacaagtctctttcgaaggatccattacacgggaagaattccgctgaagacaccacaacatttattgagaacatcttagagcaggactcaaactgcgaacaaaatggaaaatgtctcaaagagctcccaaaattaattataaaaattaaaagaaccctgaaagaaaagctgctgtgtggagaagatggaagctcagtgaggcagctggttctccacctttggaagctgttcctggcatgataggtcgtacccaacgtctcgtctgtaagggggtgaggagccgacagtagcctccttacctctctggggaaggactttgcagaggaaaggtttggttaatgttatagaggatttttattttttttaaaacaaagctatttgtttactttgataatctgtgtctcccacagcagcgggttgtctctttttttttctgtttctctccaccaggaggtaaacccactggaaagtggttaaaggtacagcattaaaagttactaatcgggggtgggggaaaaaaagcccatagatgaagaaacatgttaggccatcttgaacgtaaatgcgagcttctaaaagaaggctaaggaacacagctttggaaatgcatactttttttccgttggttttctttgacaaaatctggcgacctgtgccaacaagacctgccaggcagtgtcagattgaggaccatggaaacttttaatgattaaaggtattggttaagaaacttggaaaggccaccattgcctacattctctttttgacgaggtcgtcatgctgtccttgtaactccttgccccagtaattgaccacaattaatagggtcagaaatgggcccctgatcccaagtcaatcataggtactgggacagtggcccatgaagtggtctggcccaaaatgctgtcctgtcctgcatggtgtctaaccactccaatcctcacttgtggagaatgtggccttcagatctacccagggattccaaagatggtagacagtacggagctgagaaccacactaaagtaagcagagaaagagatcagtggatctctcggacacccagtcttggactcagtggatgtgctggggtgggagcaatggatatcagccgctgaaagagtgagaagatgacctggtatccccatgcaatgaacacaggctgcacacccactagagctactgaatgcccccaaatattccagttctttctgatccctagctgtgtgcagaaggacttcttctcatttccctgggtattattaaaacagtgcctattaactgaggcaagctcagtcttggctccttgtagcctaaaagtgcctccctgattcaccaacatgataactctaaccacgatggcaatccctgttcatggtgcatccactggtgtgccatgtggcttcgtgatgggatgatcagtcccattatgttgtgctcactcggaactgcaggccccctttccagctctctcaggggctgctctaatcagagctagatgatgcatccctaaaatgggagtcagcattcacaccacacgatcggtggcctgtggatatccacaatttcatctccgaggtgtttgtagccatggtgatgagctagaggcacttatctaaatatccatacttagctgtatgcatgtgtcacattgtaacatctatatgtcacggccacttaggtaaatagcatttgcagcccagggtaaatcctcaggtatctgtctccgaggatgtctgcggtgttgggcacactgacaactaggggcttccttttgctttcagtcataactgttcacatagaagggatctgtctgagaaatgtcacatggcttaacatgagacctgcctgcaaaaggagttgaccgcacgtgtctgctcttgggggtggtactccatggcggcacctaccctcctggaggagattgacagctgcacatccattctcctccagttcctgacctgggtcccatggccttcaattaccattgtgtcagttacagtgttttttgatttacctggaggcatgatttcctgaataggggaatgggggaaagaacgcaggatggccctggaagagcaaagatatcaaatgcatatctacgcaaaacatttcgtcagagaaacgtgggggaggcttcctccatgttggttaaatgtaaccaccgaactgggtcaatttcagaccaatgtcaatggattcacaattggcattttttggtaacagttttgacctgtttcttccaaaagtaaaataagaaatcctgaaggaatgaaacgaggtttgtgctcctctgaggaagaaactagggtgatagttattcacttcttcctttttaaaaaatactgttttgctctagaaatagttttgtattccaaaaacaacaacaaaaggtggaaaaggggcataaatggagaaatacgcttactgtttgagtcaatgatggtattaataaaagtctgattaataagtaaacagaaatggaaaaatagctacagtttttttataacccatactaccgccatttctctctttttctctctccctctctttcttttaaatgctccccaccaccctatcccactccccagctttggaaagaatgtatttttaaaaatcttaatgttttctttttttaaatagctatagaataaacagtggctggaggatgatacaccaaagaaggaaagaaacaagtgaactcaaatcaaagaattcacatcagcttttttgaaaggggaaaaccaaaaacgtcaattgcaagcctcaacccccttcttcttccccaaactgtttttccttttggtttatttctgcatcagagtctacctaggtttcaaaaccaattttccattttcctagaaccagccaaatatggagtgtgtgcaaaaacatggtagcttaaaagaagaagaagtagacaattatcaaagggaagagggaggaaggaaagagaagggaaataaagagagatgacacaagggaactggaccagataaagacaaagcaatgcacttaacccacctggagagcacatcggaccagcaaggcgctctcagccaatcgcctgggtctgcggctgggaggagagtccgcatgggttcatttggctgaggagtgtgtttcataaaccttacggtgcagctatgaaagctatcaggatcttcccacgtttcctgtcattccgtggagattggctgctggagtgcttggttgggggggcggtggggagtggaggtggtaggggaagaggatgcttgggttgttgaggggagactggctctggtgggaagtggaatcacacaggaatttattttaagtgcataaacaaaatgaaatgaggaaaaaaagaaaaaaaaccagtgtattccttttgggtcatgtgagagagccactggcaaagatgagggggcaatgagaaaggaagagagaaaaagagagagagaggcaaaaagctttctatgatttggggcactggtgaagcacactgaggcagctggaagattaaattaagtatcatatctgctgaccctattgccatggttaccggacagcggaaaatattcatcaacccgagccttttcagatgaatgtgcttgaaaaaatacaataaatataaatatatatgtatatcctccccgctctgctgtctaaatgcagaacgtcagccagtgcaccacctgatagtggagataaacaaataataataacaaaatgctcgcctccctgagaaagcttacgtcacttacaagaagcagggcgtgaacagtagggctgaccacttgttcactttctctttagctgatctctttccccctacccccttcaatgatgaaccatcctgcctggtttgattacaaagtaaaggggcaattcgtctccttattcctaagaaacctgtccgttaactacttagacagtcactcttaggcgatgactaaagctgaaacacattggaggaaaaaaaaaaaagacaaaaattacatattaataaaatcagaagcccagcaaagtcagggtaagaatgaaacaattctggtctaaaggagccgacacttaatgactccgcaggcttaaaacttgccttcttgctccagctctcagtctcaggatcccagattttgcctctcactttactcccagcagctgacactgtaagactgtcctgcctgccttgaaaagtgctgtcactgttcccaggaaaaacttgaggcattgcagagcacagccaaggagcagagacacatgaatgtgaataggctcatgagagcagaatctttcccgctccatgcacgaggattggtattttgcccttggacattctctttccgtccattcagtatttcttgagttcctactgtgtgcaaggcaccctgttgaacagtgggtttgggatactgagagactcaggggatcacacgacagcggaaggtggggttcagagagagagggaccatgaaattcacttcgctcaaacttcaccgttttgcagacaaagataatagaaacctagagtggatcaaggatttgcttaaggtccacagctgtttcactgcagactagatcttgcagtctcctaagtcatgcgcctggtcagatctgaaatgcctagatttttaacagcaagtttatctatctttccaggaaatgctactagtttcaaaactcccacattgccacctggcccggacccagtatgtaggaatgcctaagaaatctaacggatgagctcttccccatttttctgcctcacctccctctacttccctttccttccctaactctgtccccactaagataaacagcatatggtgggaaatacagtcttggcttccagatctccttcccctattgaataatcaccttcttaggttaatagagtcccacggaaaaagttgagcagacctaacacaaagttcatgtatattagccagaatgattctactctgtaagaccagagcaggtctccatgtcaagcctggctctgacaccccctggccaagaaccacaggggttcagatggcttttctcttagttaagccttcaccacatgtagccctgaccgcgaccaatcagccttctccttctgcttaggtgcaattttacacagtaggtgacattaactcggtagctgagtccccatgtgcaaccacggcaaccacagggtcccagcagatgacaggagacagcaggttgtatgatcctgtaaattatttccccatagtaacggcaagattacacactttaatatgcatactgcttgagagagccctcttcctggctgaaccaaagcgataatgcatattttgtgtctagaaatccattctaaatggtgcggcgtgtaatagacggtattacctcaagggctccaacctgacccttctcatctggtctcttccaccgacgcataagtggaatgcgtcttccttcgcacaacctcctttgtctctgggttctcctgttttctactgacactcttgggacgtattcaatacccagtccagttttagcaaggctttttgtcctaatggctgcctatatagcttttctgattcctttagataggcacactctgattcaggtgttttattttgtggggagaagaatgaaactgtatcagtaaagaggaagagggaataaaatagaaaaacgaggtaatatagaacatccggaatagactgtgcttactgtatacacataggatagatactgagtttaatgggctgaaggccagattcctttaagttcaatacaaaatacttcccaccccacagtgactcctagaagaaccatttaaaccaggtactttgtgtccctcccttggatggacacagtggaaagtgtactggagtctgtaccagaaaatgcgtgaaattcagctctgccacttttttttttttttttttttttttttttgagacagggtctcactctgtttcccaggctggagtacagtggtgcagtcatggctcactgcagcttcacattcctgggctcaagtgatccttccacctcagcctcccaagtagctgggactacaggtacacgccaccatgcctggctgatttttcttttaatgtttttgtagagataggttttcattttgttgcccaggctggtgttgaactcgtggcttcaagcaatcctcccaccttggcctcccaaagtgctgggattacaggcaagagccactgtgcctggcctctgccactttttacctgggagattacagacaaacttttaacctgtccaatccttggacaccccgtcaataaaatggaatcattataatgagtttgcacaatttttgtgagattagaatcgattagtacctagacataaaagatgcttaacaaatgttaggaccaaggcaggggggcaaggacaacatgtgtgatcctcttgaaaatgcttaagattgatacacggtattgatataagatgatttccctcaaatgctcattgatcctattagcaaaccaaatccattgcaatctgcgtggcactccaggaatatcaaatcgaggctcacagagaggttagtgaatttgttctgccactaggatgctgaattatttttcctaggcctcaatgccatctgtgaaaggggtgagatgataggctatgtgcaagcattaaggtttggggtaattaacttgcttctggggaaaatgtttaactatgaaataaagttagatccagtattgactgccctttttgttgctgttcctctttactcatctaaaaagaaggaggagaaagaggaggaggaagaggaggaggaggaaatgcttatttctggagcagcaataagcatgttccagaaaaaagatctgggtataccaccatggaatactccatgccagtgaaaggatattatgcttcaagcacagacatgcagctcttcagcactgtcattacacacatgtgagttaggaggagcagagcatgaaaacaaatcttttgtgtgatcacatggaaccagttagggaaaatagtgggagctgaactttggacaactctgaatcatactcaattgattctccatcatccaacaagccatcatcaaaaacaggcaaaacacagcccagagagaatagtacacactggaaatatgagcagatgcagtggtatatattattgtccagacacgaatgaatactgtgacttagtgagacataggccttaaaaggcaaaaatagaagcagtgtgtccttctccttctttgtcaaaggaggctgtgtctttgacacttcaaccaacgtaagaactgtgctgagtgtctgtgatgtcttttgaatcaatctcaggaaaaagatatccctgtactgaatctacaaagcctcaaatattaatacttaaggcaacttttagactctttgatggctagagaaattcaatggcaatggaccaaacccatcccaaatgcagtgtcatagagaaatgcgtgtgcacaaagttgatagtaattaatgagaaatttccaaggtcttccctcctttggcatagctcctttgtctttggccttgattctcatagaagcaagttgatcacaacggtgactactggaatggaatgctttcacattttggctttgacaattacgttctttctttttaaaatgccctttctcctctgccacctatagccattaaaacccagatccctctgttttgaaaatggcaccacctcactaccatgtacccggttctcatctcttcttcactatgtttccctaccaacttcccttctccccctccaccccctaaacaatccatcagccaggcccttcgatgtctcctggcctttttgtataaaagtcacactgcacagttctgcatgatgtgggctctgactacatctcccacttcccttcttaccactcccaccttggtccagacagtttagctttctttccctctcctttttttttttttttttttttttgagacaatttcactctgtcaccgaggctggagtgcagtggcacaatcttggctcactgcaacctccaccccctgggttcaagcgattctcctgcctcagcctcctgagtagctgggattataggcgcccaccaccatgcccggctgatttttttttttttttttcttttgagacagggtctcgctctgttgcccaggctggagtgcagtggcgtgatctcggctcactgcaacctccacccccggggttcaagcaattctcctgcctcagcctcccgagtagctgggatcatagggacccaccaccatgcccggctgatttttgcatttttagtagagacgaggtttcaccatgttggccaggctggtcttgagctcctgacttcaggtgatccacctgtctcagcgtcctaaagttctgggagtacaggcatgagccatcacgcccggcctttgcctgtctcaaacatgctcagcatcgtcctttaggacagctgcatgagttgttccctttccatcgaatgctgttttcctatgagcttggtgtggttggctccttctcgtcattctcatcttggctatgtcaccttttctgagaagacacccctgatcagcaaatctaaaggcatcatctagccacttgcaattacaccactctcttctaattctgcccatagcattatcacaatctgacacttgcctgtttatttattttcttgttgtcttttgcctcactagaattttacatttctccatcagagcagaaaccttgtctacagtgtttgccactgtgtccctggcacctagataaaagggcttaatatatttgtgttgaatgagtgccccaaccctaatgccagcatactttattacttgctattcattgtctatgacatttcatatggaccataactataacatcaatcaaatcacatatcctaatttttcatccgaggcttcaactaaaccatgaaatctgaaggatatagactgttttgttcactttgaactatttactacaaagttaggaaaattacgtagggtcaccatgtactgatatgtaggtgatacactgaacaattccaaagggagaaatctgtatcactgtgatgtgaatagcagcatgtggtattgtgcagtatccaacctgagcaaccatacagcagctcagatttctctttaacaaggaggtaaatcaggaagactttttctttcacctcttgttctaggaagaaactcagtgttccatgtccttgctctggccaacttctccctaagtccacaccttagggtaacaaaatccttaaagaaagacctcagtggactcatatagggcaactcacacgtgctgtggcacatctcctctaccctacagtctattctagcaattaatgtgatggttaattatgcacaggctttgaccagatttttgcaggtacaaccagacagggctttgcctttggatgtgcctcatacctctggctttgtgccttgtgcttctttgatgttgtcagatgaggtacctgtaggaacctgttctgcattcaggcatggtcacctgtaagttggctggctgagaacggaagttaatgaaaaattgcttctaccttttattatctgggtaaagagctctgagactgattttgaaaagttcctcgcaagttccaggtaggattcagtactattcactcatagcagtggccaactcaacaatccaccctggcactggccttcctctgttctatgtctctttcccaccatgacctcactcctatcatctgagatcacttcccctatcagtcccctgctctgtttctagggaaatctaggccaagacagttggtgccaggcatggtgaaaatcctgacatgcagtagcatcccagtcctaagatcctcacctgtcttggaaagtgataaagtatgagcagaaggtggactatgaaattctgtgctctctgtgaaatgtgcacagccttaggaaacggtcattacaaatatggagttgaatgacttctgttaactgtttttgaaaaccttgaaaaaatgataaactcagattggataactatcaatccaaggtagctgtgaaaaccaggggctctctagggcagcatttgaggaggccttcatttccaacatggcagatagagcaaaaaaccaggccaaggatttcactttgagggtagaagggtggcaaaggagatgaaatgcacagtcttagcagggctcctatgcccaagtcaggattctgaaagaaaaagaatgagactttgaaacctgaaattcaataatttgggtagatgatcctaagaatcttgaatttctggacttccttgaacctttaaacctggcaaaagcaacctcccctcacctagactcacctgcaaatacccaacatgagccaggttcccgtaagatcatgcttgtggtccccaaggctcatcccacaacctttcactgcctgcaacccgataccagggttagatctcaggacgactcaagtggagaaataagtgtctgccctgggaattaatagcttacatgctgcaggaacagccggacacgggaaatgtggaatgtgagtcttccataagaatggattggcctggcctggtggctcatgcctgtaatcccagcactttgggggaccaaggtgggtggatcacaaggtcaggaggttgagaccatcctggcccacatggtgaaaccctgtctccactaaaatacaaaaaaaaaaaaaaaaaaaaaaaaaattagctgggcatggtggtgcgtgtctgtagtcccagccactcatgaggctgaggcaggggaatcacttgaacctgggaggtggaggttgcagtgagccaagatcactccactgcactccagcctggcaacagagcgagactccgtctcaaaagaaaaaaaaaaaaaaagaatggatctatacagaagtcttctgtggaaaaaaaaaaagaaaaaaggtaattaaaacattttttttttacagaatggatctaaagggtattggaacagaacagttggaaaaggaggcagatgggcaaagaatttaatggaaaaataaggttccattatgactcagggtttgatggtctggcaaagatacctggagccagtcttagtacctgcctgggctagatcttaaaagcttggccacggcaatggtctgtagtaaacaggcaagagaagaagaactgcttttgctttgcattcaggaaagtgtcagagggtcaggaggtgggaatgttagaataaatttattatttgagaacatgaaacccactacctgactatgttgcctgggagggcccagaggacactcccttcactaagtcaataaggaccacactagtgaagcaggcaggcactaacatctgtgtgaaacccatcggtggctgacctctgtagatcagggtggacaaatggaaatgccatcatagaagagggttccctagtttcaatgaggataatagaattctagaatagcacaggccagatagtggtacataatcactcaaggcagagtggttatcattactgtaatggctggcaaggctcagctggcaaccagagatctctgcacatagatgaaaagcatgttctgatgggtgagacagatggacagctctttgaaaaggagtccctggtgtgaaactgaacactgaccatggggctctaggtgatgatgtgactgcagttaccactcagtagctggatattattagagcccttgagtcataaagttgagtaggcaaacctatatatcatcatataatggatatggtaggaatattcaggatcaggcctgagaagctccagaacaggaggccagatcctcatgttgactgaatctgttgcactgacacctctctcaatgcacactaattgtcccaaggtaggagcattttcctatgaccaactgatggagaaaataacttggggctggtttacagatagtttggcaatatgttgatgtgaactatacaggatctgatagcctccctcaagggcagcccacaagataatggtgatgggtaattctttcataatgcagagctctgaattgtgcactgggtcctcaatttggagtgaggataaaacggtctgagataaagatttacaaagactcctgagcagtggcaaatgcctcattggtcaggagcctggaaggaggaagattgcaagattgaaaaggaggaggtctgaaaaagagacttacggatggacttatgggaataagcacaaagcctatggggttctttgtctcatgcccaccacagagaagacgctgaacaagcagaaggacacagcccatggactgtcagctttccttgcttcttggctatgccagatgattagtttcagagaggcagaaagggttggtaacgcagaagaaggctgcacaaagaaagtgatattggaggccatgtgcagtggctgtaatcccagcactttgggaggccaaggcagtcagatcccaatgtggggagatcaagaccttcctggctaacaccgtgaaaccctgtctctactaaaaatacaaaaaattagctgaacatggtggcacgcacctgtagtcccagctacttgggaggctgaggcagaagaatcccttgagcccaggaggcagaggttgcagtgagccaagattgcgcccctgcaccccagcctgggtgacagagcaagactccgtctcaaaaaaaaaataaaaaataaaagtgatattggagctacaagagccacagtgaaggatgagtctgtatttgttaagtgaatactattattaatgctgctgctgctactattaataatagtggctttcatttatttgtggttacgtgatatgccaacactatgctaggcattttatacatattttcaaatttattcttcacaataactatgaattaggtcccatcattattattattattactttatatataaggaagctgaatatcctgaactattatttttactattctcattctataattccaatactgatattagttactattggttaaaaagaacctgtgcacctatcatctcatgtaaccatcataactctttgagatacgtgttattattcatcttacaagtgacgagctgaagctcaaagaagccgaacctctgccttagtgaccaaggtctccttgatctgagactacctcctgctaaagcactctatgtctgtcctattcccttcctaaaagtccaaggaggaaggctggtgaggggtgggtgggccgctgagcttggtaaggttgttacgagtgaatgagctgacatgaactttcaatgtgcctgacctatttaccaggatccctatcccagcctccctcctcccatcttttcctctctctcccccacatatgcggtgataaacaactgagctgcccttagccatttttacaatattgatatttccatttcttttttctcatgaaacaaaaggacttaagttttgagaaataaagaaataaaaagaattctagcatattcattacaaggtatgaatgctccttcccagaatgtttagagtcttgcacaggccaggaaatgtgcttcctgaagacccctgtccacacttttatctgcataactttcattgacctaaattgtatttttgtgtgcagaagggcagcccagtggaaacttaacaagtcttctcatctttctgttaaacttcctcagttgccaattaccaattctgtgcactgggggatgtgcaagacacaccaccttcaataggagcaggatgtactggttaaggatgaccaagtcaaatatgtaaagggatcccttagtcacaaagatggtgccaatgtggtagggcttaaactaggatggagaagcagatggaagggagaagaccagagaggagaagagagaggagaaagagagagatagataagagagaggaaaaagaagaaacagagaggagagagagaaagagagagaaagaaagaaagagggagagagagagaggaagagagggagagaaagagagagaaagaaagaaagagggagagagagagaggaagagagggagagaaagagttgaaggagaacaaattcaagaacctacggatatagtttctttagaagtacgtaatactgaagaggctgaaaaataattccttgaaatgatttatggctagagggaatctgggatcatttaaaatctgtcatagaggaatctgggactctatttaggagacgtttcttggagccgtatctatatctcaccattttgatcatctgaccagctgtttaaatgcaatgattatgtggctggactgatgggctaactcagtcaaacaagcccatctggaagatgatgtagagtcagtcaagatattatattctctgtgcaaatgcaaacacattgtttccattggtcattgccattcatggaatataacatggaacaaagtaatccctatgaaatacatttatattcaaagacagagaacaggggaaaccatgtcagcacctctgtcgctaactcttcaccatcatcattgaacactgacccatgggttcttttaagaataccattccatgagctatacaaatgcattttgaaaagctacacaagtcacacgaattgctaacgctaagtataatcactgcgagaaaagagaaccacactaaatcgcctcttagagttggggctgcacagcgggacttagagcagcatgttctttgtaaccagggcttacatcctaccgtggctgatgtccatagaactgtagagttagaaaagaaaatacgagtgtgtgtgtgcatgcatacacgtgtatgttaaccgcacataagagatacacaaactcacatatacacaaaaatatattcaagtacccaaagtttatccactttaccttgtatgcaaatttgattgtttaaatgttctatattgtgacacatgagatgtggctgcaatagggtggtgattagaagcttccagtatcgcctcattggatttaaggcttagacatacctccagctcagccccttctctggaataatatgtagggaactaggtattttcatgtgagaattgaacctcagaaccaatataccccaaaccaaaatcatccctttctcctctaatcaatttcttcttccttcgttctccattgattttcatcacatgaacccaggagtgcaggagctctgtctgacttgctcatgactgtattcccaaggcccagagcagtgtctgacacacagtagctgcacagagagtatgtgctgaatagtttgggtggatggacattgaagtcactgttctccccaccgtggggctcatcttgaatacttttctgtctagttatacatcaatgtctgtcatttctttctttaagaggtgtctttgcatttgtttacctcactgtgttgatacatgagatcaagtacagaaaaacgcatgatcaacaccgtgcacatttagggtaattattcctttcaacttctgcctgctagcaccctcgttgaagtcttcatccccccataacaaatccatcaggctgagcgggtctgttttccttcagtctcgctttactgcattcccatattcccgttaaagtgataacctccaaagcgccgtagtgactgtattgttctaccgtccatcaccttcaaccagaagcttcctgtggactactaaattccaaagcaatctaggccatccctgtttggggatctctgcatttttctacctctatggctcactcatttcctttgcactagaaatatttatcatctcatgctccctcaacagacttggccatttctaccttcatatttttctccatatccatctacaaaattcatggatgaataaatgtacagatgaatgtcccttctcattgacctttgcaaatcccatctacctttcaaatgccatctctaacactacagttttcttccctcactaccccagtttgagttagttgtttcagtcaccaggcaagaaatctgagagcatcaaatttatttgggaggagcagggaggagcagcaaagagtgaaaccacaatgaggaactgtaggaaaaatattagaaatgtagcaaacatagtatctttcaactatcccacctatgaggtgagggagctggggtatttatacaccaactcctgacagttattggtagagggaaaaaggagagaatataaattcccaatcactttaatctggtataacaccagaagcagccctcaggtacagcgatgtacatcctcagttgctcaggtctaaagcagtgttttctaacagaaatatcacgtgagtcccaaatgcaacctgcatatataattttaagttttctagtagccacattaaaaaacataaaaaaataagtgaaattaactttaataatgtgttttattattaattattgttgtacattttattcagcccagtatattacccaggttactattatttcaacacataatcaacgtaaacaaattattgagatgctaactttctttggtgctaagtttttgaaatctgcaatatattttatactctacatatctcagttaggactagccacatttcaggtgctcgttagccacagagactatggtctaccatattggacaggtctcagggatacaggcaggtcacttaaacatggatcattgctagtcactgagatcatcgccttctttcgctggactacttaaagtgctgatctaagactcagcatacagtgtttagaaatgttatttattttttcatgtagctaggtcttatttccctgaataaggacatatacaactaggatttacttctgttattttcccattagttccttttttattgcctggttcaattaccctttgccaaatggcagattctgggaagtcaccttatccacaggtccctaacctttcatgaggagaaatcatcattaatttcccattcaggggactgagaggagatgtgtcagtccaaacctcagcagagagggacagttagctcctggtctgacagggggaagactctgccccgagcaagacatatttaaccactatgcagacacaggaattttaaagacctccaaagagggagatacagcaaactcctctaataacaattttgagcaaatgctttcaggttttgccgaaagaaaaaaaagaaacccatctatctaacataaattatccttcggctgctttttccccgttctgccgtattgcctgcattcatttctgagtccaacaaagtcttcgaaaagcattggataggcacttggtgaccagtttgccattaaaaggttaacatgtcttcccagctaaacagaacagtggctattatgccatggaatgaaaagcaccaagagagattcgtggcacataagaggcaaagcagcgaaggcaaggagattttgcaaagtccaggaatgtctcaaaggcactaagtggtattcactgtctactaatggaaaatgtgaatttcccaagtcatttaagtaagcagatagatgtaaacatttccaagctcatcaacttctcgagaataaaggggagatctgctgaattccagacggttgaaaatgacccattcttcttgatctgaagcccaggaattttctccagtatttctaattgatggttatttatgacaaacagttaaaccaccagtaaatcagaagacagaaattttccattaaaaaaaaagatattttctacattattggttataaacccatttcttcttcagttatctgggattaaacattcaacatttaatcagtctctttttaggattattctataaatttttaaaatgtttttctacatatctctaaaatacctatttatttatcaattattatctgccttgtttttttaaaaaaattcttccttattaacttcctcccattcttccctaccttgggcccgtgattcattctcatccataagttgtcctactttcagaatgatgtacctttgagctttgtaccttggttgattggaatttctttccgtcccattttctacctcccaaaggagaccaccgttctctgtccctggttcttcctggtcacatgccacctgtcttgtctttttattcttgcttcatcagagtctctattcccagggacttcaaaggttgaaggttccagaaggcagcctcaatactcctgttaggagtactcccactagaggggttgaagtgttaccattccactgacttctacttcctttaccaggggttacttgcctccaagacaccatttgattagcaaaccgtactcagatatggaagtggcattgctcacaaactactaggaattaaggtcgtttcatttttcaaaacaaaagtttctaggaaatgaagtatgtttactagcagtgtaattggagtgaagaaaacttatgcctgtttttttagaaattaaaattatggtattttaatatgaggcagatcacatatttaaagataaaagaatgtatggaaactgctgccatttggggttggtttaaatagactcattgtaaacttgatttaatttcacaccaggcactttttcacaaactcaagtttgaaatagaaaaatgaggccttctttaagataatgaacccattttcaaagtgttgcttcaaatctcactcttaaaaagatgtaatggaatatacttgggtgtttctacaattgtgatgttttatgactatgtctaatccctgaaatctcattttctgaactttccataaattgcaccaaattctataaattaaaattggaattatataatcctttgtcttcatctaagatgaaaactaaaattacaaaggcatagcctagcaaacttaagtttttctaaattcatgtattaagtaaaaattaactgtgagcttttaccagatgaggaatttttagaaaaattatgtaattatgaaataattgtcttggtaaatttcagtttataaatgttgggcttctttcaatgggcttagaggaacagctgatgcaccttcaaattctccatctggctctctcaccaccaagccctgtctgctctggaagaagtctactgtctcacgcattctttgtacaaacatctggtgtctagcaagcatacatagtagacatacatgaaataaatgttaattgaatgaataaaccaagtcacctatggtgttaaatgcaaatttacacaaaatcaatttaatttaacatatatttatttagcacctactatttacactggaaaaataaaagatgattatgaagacatagattctgcctttgaagagtttataaaataatacagagaaaaaaaggacagagatcattctacaccaaagtgatactgataatatgttggcacagctaatagttctgaagagagtgaagatataaactctcaagcaagttagagggaccaggaaaactatcacaaaacacggtgtacaaaataatccttggacccttcagaattccagaatcctggattcaatacttcagaacatcatcatccaaagaacaaaatcaaaacaaatgaacgaaaaaatctcaaatagccacctgatttttaaggcagttaaggaatcccagccttcaattatcaagcttaaactatgtcttgttgtggctggttggttagttggttggttacccctatgtagcagatttagagctcagatgttcaaaaggttctgccactttcttgtggagcaatctcatccacaagatgcagacaatcatatctaccttaaaggtttgttgtaaagggtttagaatggagtttggcacataataagcttgaggaatatgagctgccattgataatagcaataataataatgatagtaatgatcatttgttccacttagtcactgtgccactaactctgaacctaccacaatagtactggtaatctctcacttgtataaacagataaaccctacagacagggcgggcagggtaggaggtagggtggtgatgtctctgtctcacactgactctcatacttgttctgtccccaagccccacatcactctccttttcgccggtggctctcatagaggccgttgtgagaaaatgtagtgaacgtagaaaggggtggaaatctgggaaaactccaggaattttaagaagaatttttaaataatttaaaataaaaaaatttaaatctaaaataattttttatatagtagcattttaaattttattaaaatgaattttagtaaacaataaacttggaactctgatcaaaatggcagatactcataatcaccacattttttcacttttgcttattataatccctaaaattccaccaatgaaagtagcaatttccagccctgggtccttagaattctgactctgctgaggtagtatttattttcccataataagaaagatttcacaagccttgatgaaaatgtcaacttccgttcccttttgccaaaaaaatagcaagtttgcatggcagccttggttatctaatgatgcacagaagctctgattgtcagttatatatgcctttacttaatgaatataggaaagagaattcattattattccgtcaatgaagtttgacatcacagcatggatgtccattgattttgagcataacaaataccagattttaaaaaattaattgtgaaaaattgggaactgataaatcagaaattcatttgaatttaaaagcatctttaaagtattacaaccatggctggaaaaagcaaagacataaaacagacataatgaacttcctttgaagcattattgtgaagatgaaatacgttctggtcttcttgttcaggaaacgcttgttcaattggattctgatttccacagaggtttctctttgtctaacttgaaatcgggtctgctaaggaatggggggagttcctaggcattttgtgtatcccatatgccattatccatagcccaggatctggtacagaactgggattcgggaaaatggttaatgatctggggcagtgagggaggaggttacttgggagaggggaacttagttgactaagcagcccagaccatgtccaatcccagagcaggaaaccgggcaggaaatttagggcaagagggcctagggatcctgaggacagggtgccctaaagaccacctcccttactgtcaagctgtgccttgtgtctactctgtgccaaggtgtattagtctgttctcacactgctaataaagacatatccaagactgggtaatttataaaggaaagagatttaactgactcccagttccacctggctggggaggcctcaggaaacttacaatcatggtggaaggggaagcaaacacatccttctacatgtggtggcagcaaggagaagaatgagtgaagcggggcatggggaagctccttataaaaccatcagatctcctgagaattcactcactatcaggagatcagcatgcaggtaactgcgcccataattcaattacctcccactgggtccctcccacaacacggtggcaattatgggaactacaattcaagataagatttgggtagggacacagccaaaccatatcacaaggaaagggagtttcactgtgcctttatttctcctcctctctcccataatatgggaacataacacaagacttcttctgaaatgatttgggatttattataatttggcaaatttgttattcaggctaaacgagcaaataaacacacgaaagctctttagcaaagaactcttggaacacagcacctgcttggtacaatgagatctcttcccactccaatttcagccctgacatagttactacgtggtttctgaactcatgaccagatgtgacctccctgggttttatatgctctgctgacagcatgtgatgtgcctgccaccctagaggcggggttggtgctgtcttcctgtgcagggtggccctgtcccatgttctgagttcattgacatacatgggggtatgctttacacccagtggcattttggcaaaatcagccttgcaaatggcccctcaccctggatccttggcatatttcactgcaatttacacagtgctgggggtagggggcagggaatggaagctgggttttttttttttttttcatatgtatattctgaaggaaagaaaggcaaataaagaaaataaaggagatggataaagtcttttctctttcacttcttcctgaatttcccctccttttgttttgtccttgcatctacctcgttcctgttctgatgaaactctatcctttattaaacaaacttacaatatttagatgtggcaattcagacatccaccattgaaaatatagaagcagaggtggttaaaaaaaattccagccaactcactgtgcaaaaggggatggtcaactgattttgaaaacttcagaagaaaagcaaatgaaagtttcaaaatctgtcatttcagtttgtaaactcttccagtaaatagtagccttattattagaagtatatatcagaaaaatagcatcctggcagctctgctgtgccaggaaccatagtaaggggttggcatgaatgttcgcataagggaaggacagtaggctgggtgatttaaatagagtaatttctcatctgtcagctgattccttccaccagccagtccaagccatctctctgtgcacctaccatgtgcaaggcatacaggcaacactggccattttttatacataaacacattcttttcctattacttggctttctccctcagaaagtgacaggaagtccactagaattacagaaatgccatgctaggaagaaccatagagattagcaagtccaaccccttcattgaacaggtgattcttgcaaagttggagtttaagggaggcatcgtaaaacatcaactgaagtcttgcggcctttccatgacaacatatgcacgggatgaaaacagaaaggcagaagggcagaaatcatctttgtggcccttctgtccctaccacttcccaaagagctgtgaaaacagcttgattctcatgttctgattcgcatgttcttgattctcacgttctggaatgaatgaactaattccagcactcaacgcatctcatttctctctagtgtcctactctacggaagcctctagatttgctgtggtaaagaattcaaagatcaaactgatgcagccctggccttccgtgagctccctgcttaaagagcaaacctctagatgcgactcttattagggttagtgtgcaagtggtcagctggtattctgctcttctgccttcagagtcatctgtgtggtcagaggtcttcgttttccatatttgtacacagtctttccccaggtgggctgagggcagaatgaatatttgctctattttcacagagggccagtatgcttgagcaattaaacagaagctcttctcattgtccatttccttcagctaaacactctacacaacatggtcacgtaagaaggactgtctccaggttcgaggtagagctgtgactggtagaaacccccatgccgtaaagacacaaggaaaaaaaattttccctgcctatggaaggcattgctcaataaggagaaagagaccagggcaaaccagcgacatgagggcattacaagtcaagcttcggttttacgtacagttaattctctcccgacctggggagattcctgttggcgatttttcttctttcaggttttagcacttacatttactgatcactaagtcatgtctacatacaagacaaaacccaggacaagccaaagtcacgccactgtatttataaagctttccacacaaaatccagtaacatgtagcttaaaagtagatatggaaagggacgcgatttgtttgctggagtttagctaatgagaagaccctccctcttaattcttgtgcaaactcaaccctatctaataaagtgatgaaaaagaggatctcacggaaaagaggtcttaaaattcacttacttagtttcaagaagaacaaacagaagagaaggggtgcacaaactccgcgtggacatccagtgcttaatttcaggtacagacaacatgcatcttggtacaagggtacaattttagctgcacaccagtgtaccccaagataccactaagtctaaatacaccaccataaaaggtaaaaggatggaagtccctatcgttgcctgttcccctcaggaccagcagccaatatctccccgacctcctagagagaccaaggaagggttcaggcttaatcacttgtacaaaatacaccccttgcaaccttttaatatttctagtaatttttctcttaggagttttgagctaacataattctcaagacacttcccttttaagccttacatcagcagaggcgaaagcagtgtgttcggagacaaaagcaggtgagagccagacacacgatttaccccaagcttctgcctcttggtggccttaatgacaaagcttttaactttgtacaatccctgcctctcaaacaaagacatgattaaaagaaggtggttggggacggggaaggaaataacataaagatgaggacgtgcaggaagccagcttggtccctgtccggcacacaatccattcttggccaggaaaatgattgccgcacaatggccagcgtggccagtccagggcagctgtgagatataaattgtcagcaatgaccataagcactcagagaaacaatttaattcctcacttccgccatcatgggctgatatattctttcaaggtcattacccaaggctagaagggtcgcttgattaacgagtgacaggcccaatgagggccagtgcgctctagcaaggccttatattaattagacagaagctccagaaaataaatgttacagagaaaggaggggccaagtcttgagcgtaagctgtgacctcgccacccccaccctgttcaccccacaaaagataacaccctgaccttgatccttaatgttatactttagcttagttttaaaacctataaaatacaaaacataaaccaggcctcgtttcatattcaaaatgacccaggccctggcctccagttttgacactgtctttgtctcaccctttctcacttagttattctaatttattggttaattctgagcggggatgaggagaactgctggctgtgaacttcacatctcagaagcagcttaaaccatgtttatctgagccaagggaagcaggagaatgatgacacttccagtgttttaagcccagtggctaataatctagcaattgctctttaataaactgtcattatcttgcttaaggagttaaggagatttggcaatagcagtggacttgcagggcaaatgaccattcgaagcaaaaggggcttaaacataccctctacttcttatctagtattcggtacctctttgattacatttactatacagtcctcattttaagagacacaaaagaataaactcctagagaatttagtgaatttgaagtattcctttccaatataagagacaactagtttgagaatggggtttcacttccaccaaccatcaagaagggctttttcctttctccactcacacattcaccattttgatcactgatcccattggaaaagcaatcttgccatctcaggcagctccagcctggctgctcgttgtggatgcagagcaaggctatactatatagtttttttgatttcccagaaatccatcaacgtctattcaaaagagttcaggtggtgaaggtaggaggcttaggtgacactcaggatgtgaagggttgttgacagaacttcccagcaagaggccccatttaccttgcattctgtcaaaaaggagaaaagaggttgtacttttgagacaggttgtgtctatgaactcctatttggcaccaccttctgactaaatactgtacatacagacaggcaagaggcaggtcactgatggtccctctgagagccttggggacctactgtagttgacaatgtctgagaacttctccagtgagtccggtctcctggtacttgggcgcttatgtcactccctccccttgagtataggagggacctaggggctcacttcagtcgaatagaatatggcaaatgttatgggttgtcacttctgaggctaagctactaaaaggctgtggcttctgtcttccttgctctctttcactctgtcagggccctcactctggaggaagcaagctaccatgtgttagctgcccctgtggaaaggcccagaaggccaggaatgcatagctccagccaccagtcagtggggacccaagacctgccaccagtcacgtgtgtgaacttggaaatggatcctccctacccaagccttgaaatgatggccacagccaacctcttgatagcagcctaaagagagacttgagtcagaggcacccagctaacctacataaatccaaactcctgacccagggaaactgacataatagatgcttgttgttgtttctgctaaatcttggagtaatttgttatgtatcaatagaaaactaatacacccactaattccactgatcctatgatgtactgtgtgatgcagaacaattcaactgctctacattttagtatccttttctctaaaatgggagcggcctcctggagagctttgacatatgggaaacatctgcaaggatttggttctgttcgtgggaagggaaattcgatgcattatcactgtattatgggtatttaatgtacactaccttatcagatttatgagttttgtggaagatgtagcatcattatcaggcacgattattacactatattttacatctctgagttatctgtccttgatggatatcaatagcagtactagccaacaaatttgcaaagataacttacacacatattcattcatccatttctccaaccatccatccttctatctatgctttcaacaactatttattgaggatgcaaaaacaccgtaagaggtagaaaaatgtattcaatatggtctatgtcttcaaggagtttacaatcccagcagggaaattaatgcgtggacactaattactgaaatctaaagtagcatgggataagcaatcattagagtagaaaagtgcaggagggagtcggaagggggagaattcagctgtctggggaaggcttgaagaaagcctggaaatatacattaatgctaaggaaatgtgctatgaactcttattcctgaagtagtgacgatgtgttggccatagcctcttgttcagtcttgttttgaccaacaccaaacatttgaagcacagtatcaggatggagttatggtctgtagccagagaaccaaggtaactggcaccatgggaatcacacacaggactgcagcttcatgacaccagctacagtataatgatacattacagaacatcaacctcctggatgcaggacaggcatctggctgtccaaccttctgaattgagaacagcctgtaacgaatccccagttccataacatgtttaacaattaataagctaggggtttccttgaggacaacaaagaataaaatatgagtttgccaagaaagaggtcacacagcataaatacattctaggaaaacaatactcgtgatgaggctagaggtgggcagtttttcctctactttgaaaatagagtgaaatacattgagggcctaaattatctggacgttggtcagtcctgtatttcattccgccagttagaccccttgtatgtttgtgataattttgcccagtggaccgagtggctgctgagggaaaagctgccctggtcaaaggatttgctattaatttcagatatgctcttaaaatgcctctataagaaaggacaagaaatcaaagggtttggtgccaaggaacaggattaataaaaaatattgtgtccgttctagagaagccaattcagcgggtttcactcatgtgatgtgttcaaacagcctcccaaagagagaaacttagcatggcacccacccaggcagggaggttactggcaggtccccggcagcagtgacactcagagacagcaaagacctgcttggctcctgcctcctgggagcctgctgaggtcagctagtaggcttgatgaaactactctctggccagtgccccttgtccaggggacaaatgggaaaatatccgtcagaatctaaagaataattccagaaagagtcatacctctgaggaagtcaatggcactgtaaatttacaccttcacctagatagtaattcggtggaaaatgacgttcaccctccaaattcctgattcagagtgctcgaaataattgtgtcatttgcaagcatcccaactgatgcacctgtttctccgtggcttcattaggggatcataggctgtgtgatgacgcgtagcaaccaggcagcagaaatttcttagaaagtaattccccacatgtgcaaaattcagctctatgaggaagtattttgggtgtgtgtgtgtgttggggtggaaccactccattgtatttgatagttgaaatgtatcgcttgtgtccttggttaacatattagcctgttttcacgctgctgatagagacatagctgagactgggtaaattacagacaaaaagaggtttaatggtctcacagttccacgtggctggggaggcctcacaagcatggtggaaggcaaaagtcacgtcttacatggtggcaggcaagagagagaatgagaaccaagtgaaagggtttccccttataaaataatcagatctcgtgagacttattcactaccatgagaacagtatgggggaaattgcccccctacttatctcccactgggtctgtcccacaaaaattgggaattacagaagctacagctcaagatgagatttgggtggggacacagccaaacaatatgggaacacagccaaacggaagttaattacctcctctaagcagctcaggtgtgaccagtacttccagagatgttttccacgtctgataaactacttctctcattccaaaagttacaatagttacaaaagttacaataggcatttcaggtttccaaattagagttcagacactgtaatatacttatgaagctcccaaaatgatgccaaaggggtctgtggaccccttttgggactccttttaaggagcaagattctacactatgattttaaccctatcaacattcctcaattttctgcaggctttcattgattaagaaaagctcattacaccttctgaggtgctgtcttttatacattttgctgtccatgcacttttcacactgcaacatgattgtttgtgtgcttatctatattatctttatattacaatctttatgaggtcatgcctgcattttatttgtcttcataaccccagtgtctgcccagaaaatacttgacaaccaggtgtggacgtgaattgaattctgccccttggttaaggctaaacatccagttgccagctgggacagttctgcactggagaaacatgccaacatgctgaaaacctaaaagttgtttttatgctcctaacgggagagatgaaacaggggtatacagtatttttggtcaaacatgccaaatagcttttttcttccaagctgtcactatttgttgggaaacttaccagttgcatggctttttagagattcaagatgtcttgcctttcctaatataaatctttgttgccagtctaattggttttgggctcagtcttggcacagccacagccttggccacccttctttgccctcagtgccgctaaatatatccccagtgctcagtatgtccagatgattctcttctaacctttcaggtcaacgtcttttgctatttatatgcttttgaaaacctttcaataataacttccccttcaaaaaacactaatccagaacttacttctctgcctttcttatgcgacaatttttatgcaggaattgtcttgtttttttaattaagaatatttcctggccaggtgtaatggctcactcctgtaattacagcactttaggaggatgaggtggggggactgcctgagctcaggagttcaagaccagcctgggcaatgtagtgaaaccccatgtctataaaaatttcaaaagttagctgggtatggcagcacacgcctattgtcccagctactcaggaggctgaggcaggaggatggcttgagcccatgagctagaggttacagtaagctatgatcatgccactgcactccagcctgggtgacagaccaaaaccctgtctcaaaaaaaaaaaaaaaaaaaaaaagaatatttcctttgatggatgtgaactgcagatttgctatgtcctactgatagaatattgttatttttaggctgtgcacagtggttcatacctgtaatcccagcatgtttggaggctgaggcaggaagattgcttaagaccaggagtttgagaccagcctgggcaacatagtgagaccctgcttctataaaaaatttaaaaattgactggatatgtggcatgcacctgtaatcccagctacttggaaggctgaagtgggaaaatggcctgagcccatgagttggaggttacagtgagctatgattgtaccactgcattccagcctgggcaacagagtgagaccctgtctctaaaaaagattaaaaaaaaaaacaaagacagaatattgttatcttagtagttgatacggtttgtctgcgtccccacccaaatcttgtcttgaattgtagctcccacgtgttatgggagggaccccagggggagataattgaatcatgggggtggttctcccatactgttctcattgtagtgaataagtctcatgagacctgatggttttatatggggagacccttttcgtttggctctcattctctctttgcctgtggccatgtaagaccttcctttgctctttctttgtcttccaccacgattgtgaggcctccccagctatgtggaactgagtccattaaacctctttttctttataaattacccagcctcaggtatgtctttaccagcagcgtgaaaatggagtaatatagtagtcatcaccagaagcagaaatcagtcattcattagttaactctgaaagcatatctctggtacataagaggagggctggaactaagctgcctgaatctgaatcctcactccccacttactaggagtgtagccttagtcaactaacctaatctctttgtgcctacatttccttattgtaatgggaataataattgtactcacctgatatggtttagctctgtgtccccacccaaatctcaccttgaattgttataatcttcacatgtcaagggtgagaccaggtggagataattgaatcatggaggcagtttccctcatgctgttcccataatagtgagtgagttctcaccagatctgatggttttataagggtcttccccctttgctcagcactcattctctctcctgccaccctgtaaagggggggccttctgccatgattttaagtttcatgaggtcaccccagccatgtggaactgtcagtcaattaaacctctgttctttataaattacccagtcttcggtatttcatcataacagcgtgaaaatggactaatgcaccacctcatgatcaaggatctcaaatgcgctgttacgctgccaggccatcagtgtgcttatctatccatgtgctgtctcacactccaaagtgactatgacattttctcgtttcatctcaaaccatcaatgcctcttccccatcctcactttttgcggagggcttggcttcctacttcaccaagaaaaatgaaggattcagaagtgaacttccaaggactcctgactatcacttgtacccatcaaccagcttctgcattttcatattctgccttctagttaccatgcataaaccactcatcctcttatctgaagtgaaacactttacttcatactagatcctattcgtgccaacagaaggctctctctccatctattctcccttcctctcttgcatcatcactaattctctctcctacgggtcattatcctcattctcttggtaaccagatccagtttcatggctttaaataccatctatgtcccaaggagtcccagatttgtatgcctagctcagacgtcccttccaaaatccaaacttgaatatccaatgggctaatcagcatcttcacttgaatttttaatagacctctgaaaatcaattaagtccaactgtttttctcctctaaatctgctcatccctcagccttaggcatttcagttaatggcaacttcatccctccatttgctcaagaaaaaagtactgggaggtcatcttgaactccctctcttttacagccttcttctaacccatcaggaaatcttcttggtgcttcctcctaaatgtacacagaatccaaccccaaccacttcttatctccccattgctgccaccctagtcagtgctaacagcatttctcacctagatcatggcaatagcccttgatctgcccttgctttcgtgctgcctattctcaacccaaaagccagagaaatccttctgatctcatctgaaacccaggtgagatcatgttactcctctgctcaaggtcgtcagatggctcctcctttcattcaaggtaaaagcccatgttcttacaagggcctgcaaggtgatctaacacccacctcccttacctctatgacctcctacttctcttccccttgcccattcagctccagccatggtgaattcttcaatgtttctttaacacacaaagtatacttccactttagggcctttgtacttgcagttctctctccctggaatgctcttctccttaaatatccacaaaggcaatgctttcgcctccttcaactctttgcttaaatatcctctcaatgagttctaccctaaccatcccatttaaaattgcaacctgccaccaactccagacctttcagtttctcttacccttctgtctctctcggctttattccatctcatgcatcaccttctactacatgctataatgtgtaactttatggtgtttatcgtttgtctgccccagaaggaatgtaaccacaaagggatctctattttgctcactgatagatctcacacttttagaacagtagctggcagatattaggtacttgataaatacttgctgaattaaattgcatttggtttgaatgataggtgttctgaggatcaaatgagcttcatatacataaagctctcaaaataatgcacaataaatgttagctgccacaccatcactaccgccatcatcgtaatcgtcacagttgccaaattgtgtgtctgagtctttcttgtggcattttataacatcagatgtaaagacaaatgaataatcaccaggatattttctttgtacataaggaaacctttagattttggtgggtataatccatctcacagtgactccccaatcatctcactctcatgacccatgcatggagtgggatgctgttagtgcccttttcacggggagaggaagcaggccccatagccacctagaggggatttgattaagcgatgtgatggtaaatgcctgacaaccaactcttgaggaaaaaaaaaagcaaaaaactttgatttgtagtgttagccgatttccctggtgtaaattctcccactgtggttgatttcaactttccgacactatgtccctgaatggagagctcaaaagttgtacaataagtagcaccccataatagcctaatttcaccagaaatgcaataggcatatataacttcaaaagcacaaataagagtaaaatgtattaaaataattaggaagcaatcagttttgagtaattgttatttaatcgtaagtttaatttcatttttaataaatgttgtgtttaacaaccttctcatcaaaattcttaggaatttaacaatccactcttgggagctggtatgaggagagttcagtgcaccactggtgagatctgagtggctatctgacccaaatggggtcaatcagggtctcccctagagacagggagttaaaccttcaagaaccagttttccacattgctggagtatgaagttgggaactgtggacagacactctccatctcccatgaggacagggtagtaggaaaagagtctactgagagaataatgatctgcaaagagaagcagcaataagagaccaagaaaaaattctgcctgtggtgcccatcacctttcaattcctgactccagctatttcagagggttggcccttgggttctatgtgccccctatcttttttttttttttttcttagaaggagtctccctctgttagccaggctggagtgcaatggtgtgatctcggctcactgcaacctccacctcctgggctcaagcgattctcctgtctcagcctcctgagcagctgggactacaggcgctccccactatgcccggctaattttttttacttttagtagagacggggtttcaccatgttagccaggatggtctctatctcctgacctcaggatccgcccgcctcagcctcccaaagtgctgggattacaggtgtgagccaccgctctcggccaagccccccatctttaatacaaattttctatcactgtgtaagctggagatggttttagatacttgcaaacaagtgttctcagcatatattatgcttagttgattggggttggctggagttacaccagtgcagtcaggcacaccgattacttgatgcttctctacaggtatagctatctttaaatagaaaagtgaattactacataataagtgcatttatgtaagtctaaaacattttcaaaatataaagtttatatcagaaaaaatataattttaaaaaacattcaaaatatgaagttcacaccaggaaaaaataataaaacaggttcttggtagtgaaaattttgggagctacagcctcagtttacattggccagtgttacccaaaaagtcatcattcgctaactttagacacatcactttcattattcttgctgcaacagtgtgccaccaaagtcaatgcactgcagaaaagaaatgcaattccttccatctgcataaagtataacctcatttaattgtaacctaagtcaaagtatctataaaatcatggatttaatatgttaatcatattttcatacactttcgattaaataagctatttttaagcaatgttgctgtgtgtgccacctaaaatgatacccaggacacacccaggaaaacatcacatcagttaggcttgattctctacagctgttcctggcacatgaggttttctccgtctcactcctgcgtagcccacgagagtccggatttgtcagaggactatgtttccaggctccgggacaggaggaactaatctgctgttattaaaatgagagcaatacatggtaggcacacatttaactaagggatctgtgttttattatttgggaagatgtatttgcataggttaattcaatgacattctttattaaaaaaaaagaaagaaagaaactcacacagtgagcagcggccaatcctacctttcaacttcatgttaatttgccttagggtttatctgagctgagcatccaagagataccagcaataagttatctatttcatcacatgctgggcgaataagagacctgtctcagttatgaccaattgaatttattctctcaacacagagtatccaagccctaagtagacatgatgctttgggctgatgcttatctttaaaacttcagcagctgatggctcagagttcagcatcaccaataccactttcagccctaagaggagaaagctcaggaatgttttcttgtgttctgattccggctctaaatctaaagtcacttctttcttcttctttttttttttttttttttttttttttagtctcactctgttgcccaggctggagtgcagtggcgcgatcttgactcattgcaccctctgcctcctgggttcaagtgattcgcctgtctcagcctcccaagtagctgggactacaggcacgtgctgccacgcccggctaattgtttgtatttctagtagagatggggtttcgccatgttggccaggatggtcttgatcttctgacctcgtgattcacccgcctcggcctcccaaagtgctgggattacagatcacttcttaatgacttaaacaagtagcctgtaagatcagcaaatatagaggctacaattgtgcttaatgggaaggcgaagcctgaggatccaaagatgagtcagtagtccaagtccctctccacacctgaagcagttcattcttcaggagtcccatgaaaagatgctggtgccacaagtcagaatgcttttatacctaaccaggaagatatgacatgtggtgaagggacaaaagctgaccatttagggtcgtggcttttttgaaatcctatggactatcaagccacaaagtagtatcttggaattcgacttatcgatacaatcttgaaaaggccattactaaaagtaactcttacccttgccttcattcttcatatatggggctcactgctttaaatgttttctagagtcatgctgactggtcatttttgcattctgatttctttttttctgagtaaactgtgcaaataaacagatggaatgtccaagtgatcatataagaacattctgagcaatgaatatgagcagcaagtcatcacgcagcacctcatcacggcagcacatgtacatatcacgtcaatgactgttatatcattgtgtgtgtgttttttaacactagtcagcctaaaataaaaaaatggaaaagacttcatgtcaccagtttttcatcttaggccctcttctgtttcctctgctacacagagtttggaaaaaaatttcaccaaaggctattgaaataaaatataattaaaagttcatgaaaaataaaaaaaagtcaccctctacttgagtaatcaacctcaatttcagctctgaaggtatcatcattaattgcgtgaagtacatcattaattgcattttagaaaaaaaagcttcaatatttatttctaaaatgacatctccctgaaaaagtcatgtaagttttctttccttgccaaggaaataatcttatctcctaccaaagcaaggatgagaggagacatttggacaaaagatctgggaaagtaacacacaaatgtccccatctcccatgcaaatggcctcgtttcttgcgcagcccctaattcctcacgtctgccacatgcccattggttaatacagcggagacatgagagtttagaaatcccaccttcgcaagcttgacacctcatatggaagccgtcagaaaaagtgaacagatagatctgcgctccttagtcatcgggcaaacgacaataacaatgcagcaccattttctgccatcttttcaataaacatgtcttggataggtcagtgcaaacgatacagactgtacagtgactacctcagtggactaacctaaaagcattagtcaaatccaaagtctctgagataccttattggcagaaacaatacctgtaacacatgaggcaggaggtacgtgcgatgtgtcccctaagcaggtatgatccagagagggaagattgtatgtagggggaaatgacagcattgaattttaaattcccactaaaaacagaaactaatagcctatgttatcaaacagctttctttttttctttctttcttttttttttgcctttgaaaactaggagaattgaacaagggtatctatgggcttccaagtatttcttctgtgactgtgtggcctggtggacacgtgcatagtacacctatccctgcattcaagccatgagtttgggaatgtccagaattcgattccacattgttatcaggtgaaactgattttacgcgcccacccgcctctcctgcaagcccccaaccccctgaacatttctaaacttccttgttgctatggctgcttcttctctttttttaaatttttttcccttcctcttcttctttttttttttttttttttttttttttttataaggcctctggccttataccgctgtttattacctcaggcaaactctctctctcactccttttccctctctgtttctttaaatctgtaaaccacaaagcagcatgccagcaacaccgtgggtcaagatatcaaaagagggaacttttataggtttcctcgataacatggacaataaaagaagaagggcgcacaagcagcattactgaccttatttgatgctgttcagtaaagagagacggctcttccaccgcctgcccgtgtaggtccgggccatcggtgtgtgaagagggaagctctgtatcaacacctggtctgggttttcttacactcctatgccaaagccctccaaatgttttcggcaaataatacccaaataaatggaaggttactgaatacatgaaactcactgcagcaagaaattgcttttcgacgcccagtatatacagacaaactgtttttctccccacactcacacatatgaatatcggtaggaatttagactctgctaaggacatgtgtgctatgaaagcagaggtctgtcttccaaatatgatcgctgttaatcagcagtacttacgctgccataagctatatattttggtgattagtattagaaggagaatgttggagctcattgtcataatgtttcatgaagacacatcatgttgaaacaaaatgcatgtttctttggcctgacgtgcctgctggttttcatgtgatatgggtccaagaggaaaacgtctttagcaggccttaggaataactgcttccacaaccatatgggctaggcgaagtcctagatgagtagaaatgaaacagaacactcctgctttcacgtgaaactctttttttgttttccaaatagttaaagtcactttaatcatctattttcaaggaagatatattttctctcacagtaagaaactgcaaaggaaataaccccttttttcttcaggtccccaaagatcccagctcctaacttttagtcgcatcaaaatctcctaagagaatctagtctatgcctccattgtccagccttaacagagaaaaaagatcaatcatttgagtagaagtaaaagcaggaagaggatcaagagttattttctcctatgctgaaaattccattccctggctcctaagaagttgcatacacagtttcctttgactttttcaagtattttttaaccacttgctctttaaataataccagtctgaaaatcatctcattgtccaccaccttcactgttttctagatgagatactgtgctcggtgaacatactcctcaatggcaaccaagactgtgaacaccatatttgccaattccagagtcactctcacgcaaagccatcaacctgctcactgtcagaggcctctgaggacatcagtgagggctgggctgagcctaggcccacagagagatgcaggcacgtactgcttgggctatgcttcctaaatgtagggattttggacccaggaaaatgagatgctcttttagaatagatggtaggggtcatctcagagacccagtttccccagctgtttccagaaacagcagccctggccctgcctacccagcaggagttaccccaaagcaccaggccagcctgacccagagcctcattctccacccgtccatctgcagcctggagcatgtctccacctttatgaatatttattttgggcccagcaaattcatgtgagatttgatgtgtccttcccactctcctctccacagaccccacgaagtattaaacacatgctatcatcccagcactttgggaggccaaggcgggaggatcacttaaggccaggaatttgagaccagcctgagcaacatagcgagacctcatctctacgacaaatttaaaaacttagccaggcctgtgggtgcacacctgtggtcccagctactcaagaggctaaggtggcaggatcgcttgagctcaggaggtcgaggctacagtgagctgtgatcacagcactacactccagcctgggggacacagcaagactggtctcaaaaaaataaaaataaaaataaaaataaaacagaaaaagccatactatcaaacacacaaaactaggaatccaattctatttatttggcagatgacctagaggctccaaaaatgccaagagcaagtgcttggtccctgcatgcagagacggatgcctggtcctgccatcaccccttttccttacatgggacgcttggatgagagagaggcggctcgcgaggcaaatacgggagtgcagtcgccattcctccttctgtcttccctcccagccctgtcctcctgccctcctgtttggtggttctcttttttttttttttttttttttttttttttccctgagatggagtctcactctgtcacccaggctggagtgcagtggcacatctaggttcaccgcaacctctgcctcctgggttaaagcaattcttctgcctcagcctcctgagtagctaggactataggcacctgccaccgtgcctggctaatttttgtatttttagtagagacggggtttcaccatgttggccaggatggtctcgatctcttgacctcgtgatctgcccacctcggcctcccaaaatgcttggattacaggctcgagcaaccgcgcccggccctgtttggtggttcttttagcttaatgtggtgacaacacagctcccttagtgatgtcaaatcccttgcacgaatgcagaaagcgtttttctcccacacactttcaagtggccttaatggagcctgtgggaaggctgactgctcacagtggaaccagaacatttgggtgggcctggggcgggggctgcacagggtgggactgggctgagatgtttgaatgacagtatggtgatgtcagtgcgacctgagcatttctaaacatgcagaattttttttttcccaacgtccttatttttatacaactgagctaaatggacagacacctgtccattgtgaccacttgaattggtggagtttatacgtccaggtggaatgagatgactcttaacaggagtattggtctacagggtaacctctcatttttcagtgtcacaaactagactctaaaatactgaataaatctgttcatgataaggcgtttttgtaagtgacttgatatcattatcttcatttgatatagcaggaaatatctggatttaaaaggaatctgcatggggttgccagacttagctagttaaaacaaaaagatgcccagttaaatgtgaattttagataaacaatgcacaatttttttaggtataaatatgtctcatgcaatagttgaggcatactcatactaaaaaaaaatatcatgtatctgaaattcaaatttaattggcatgttgtattttatttgggaaccctaaaccttcagagcgtgtgtgtgtgtgtgttgggaaggggttagagcaatggaacttcactctgttgtgtaaattttgggggaaatgtattcctaacccctggctccttgcttggatagaaatatggccactgaagagaagatcagatgagctttgtagtttttaaccgtatatttccaggtgcctggggaccacgggaaggagaagggttgcacaggcgatcctgaatcaccacgtgaggaggaggctcggctcgggcaggtatgtttttcaacacggctctaacagagcgcacacaggtgattaacattcctctgctgaggtttatgacttcattagaatatttctcatcataactgaataggtaaaaaatacctggctattaaatacaagtctatccctcaggatgaccagattatcacttgaatttaaaatctttctgaatttttaatagtgcataacaaatacgattatttatgcactttcttccagtactcaacttgccaggcctacaattatatggaacgccttcagtttcaatgggagggattaattggagctgtgcatctcggcctggtcccccctttccttgtgacctggaggaagcctgtccggaatcctttggaggcaccggcagggcctggctctgtgttatttagaaacccctggtaattagcagcggggagatgtaagagccgtggtgtaaagggagcagctgggaatccataaagctggctgatgagaaagtcaagtggaggcctgcctggctgaaacatcttcaatagatctgtagtctgggcttgaaccctgccctctcacctcagggtccgatatttctttcttttccatttttttcctctgcccaagtcccccgcccccaccttctcttctcctcccagcttctctatcaaggaatgatgtactcagactgtgaataaatgcgagtgacccccatctgcccacccccacttcccagagccttctgctggagaagggggtgggggagggaggacagagagagagggagagagagagcgagagagggagagagagagagagagagagagagacagagggagagaggcagagggagaaaggtacaagagagagaagggaagagagagagggagatagagcgaaaaaggagggtccccgacttcctcacaggtaattaaaaggactgttttcaaggttgcatgggcaaagacaattcggccctaatgaagcatcgatcgactgcagtaatgtagaaaggagctgacattcattcaaaggtacctttaactgtaagacactgcaccgggaattattcgttctctgctgtcattgcctaggacctgggttagggagaggaaaaaaaaaggtggggtggaggggagagtttgttttacatttatttccgcatcgccacaaatgcatgtgtcggggcttctcttttccttctcttctttttaaaaatagaatgcatcagagcacagtctctttggatgtaaggaggggggccctccccgcttagggtaaattttcttcattagtcacgtttaaaagcccaccaatcaggcctgccgggtccggaattcaggaggtcagcgacagccaagcaggaactctttgggaagggtaggggcattgctggctggctgtaaacccaaactcgtttccctccacgggtttggccgctgtctgctttgtgctggtgtttgctattctggggcaaaccccagaaacctcgagggaaagagagcttggggaacggggacctatcactgtgcaaggggatgttgacgatccagccaaggggatggggatctggccataaagagaccaaagatgcttgtgggaaggagggtttcggcaatccagggagtgagacggggttttcgggttgcagaagaatgccaggtaaaggtgtgggagagaagcgaggctgggagtcacctcccagtccacctgggggacacttcttctgggttccccggccgtggacatgacttcttgttttcctcattagccctaaaaacatttgcctttggagaggatccaaatgagaataaaaagatactaaagtgctagtcgtgccaagtcaatgggggaggacgatgacggaaggagagtcagtatccattccaaaacaagtggagtgttatctggaaaggttttgcccacagccccagctccactggatcttacacgaggcccctcatacaacaatagcaggtcccttcagagcacgaaacacaaagggaatttgctctggttcagtctccacagtgaggcccctcggaagctaaagagagtcacttccccccgacccccacctctgctaaaaataagcgtgggaggcaatctcagacccccataatgacatccagggtaccataaacctatcctgttggcaggacatttcaaatcacgggctctttctcccattttctttctctctttccttttcttctcagaatttatcgtcgtttcttgattttgcctttaattttggtttggttttagagggagggggtggcagggtatattatttaacttgataaacagcattagcacagcgctgggccgcctcctggcttcggcgtctctctcctattttttcatttgtgtttacatttctaagacatccccttagctgaaggaggatgcttcccacatattgcactataggccattcatgcaaaaggataatttattggccgcacagcctctgaagttgaatttttaaaaagaaaaatcggagcccagtttccccaggtttgctgcattcacttgtctttagtttgtgctcttcttcttgcctttatctttgaaacagtttataacattctatttatcaatttgatgctgtttcctcctggttgttatttatttacttatttattttgtgctgccaaagaacaggtcaggaaacagaggcagaaattgggtggaacacctgctgaaattaaaaaaaaaaaaaaaagttttcccctaaaaaatgactaaactgcagcccagcagatcctatctgcattaatttggctgaacaacaagatattgcaggggacaaactctgaataaagcagttccgagttcccagaattggcacagctcagcctaaacaatgacggcttcctattcaccttaacccagcttttcaaaagaacatccccagaaacacaaagcatcagcgggaaatggcaattttatgaatcctaatcaatcaaagggcttattaactcaatgtgaagccagattaaaatctttaattataaatcgtgctaaaaggaaaaacaaaatgtacttatggtacattgaaaattccggatattaacatagttgctattatctcttgcaatattaaattccccctccctttcccccactacaacctcacctttttctattactaaagaacagggctacagaacccaaatcatttttcccctcgatttattaaaatgtattctttttctccccctgtgcatccaataggtttctgggaagctgcgttggaggctgtaggaccgggtatgagaaatcccattactgagccccgggcagctagggtttcagtgtgatgctggaggtagtttgggtagctgtttattaagaggacagagttggtattacagggtcggtagttgttttgttttgttttctttttggcggggggcgggggcgggtaggaagaggacagcaatcagatggggagcatttttgctaatgaaagcggcatgcgtgtctgtgctcgtaggtttgattggcaggagtggagattgccagccccaggaagggtcctcgctttaagccatggtgtgagaaaaagctttgggtgctgctgttgctgctgctgctgctgctgctgctgctgctgctgctgctgctgctgctgctgctgctgctgctgttgcttctttttcggcttcttcttctccttttttaatcaggcagacatttgggaaatgaccacagcaaatttaatcacagttggggggtgaggggggagggaggcagagcagagactgtgattcacatgttttatttatttgttcagagtcacggccatcctattgtgtgtccctcattctgtcatttcaggcccctccgacccacccctacccctgtccccattgttaatgtaagaggcagagaatataaccacattttgtaataataacatatccaacgttgcaaaagcaggcacctcatcttgagaggggtccttttcttacattgaaatgatagaaaaacaaaaagaaaagaaaaagaaatctctccatcctaatgacaatgtaggatggagagatttattctttgtgtaaaaatgcaatgatgttcctagctagggtacatgccccatttcctcccctcctgcacatcggctatggtactattctatttttatatttacagagcaaaccccatgttaccaaattggctttaaattaaatataaagggagcgaaggaaaggaagaaagaaagaaagaaaaaaacctgtactatcaaagctaataaaaagaaagtaataccctggtttaaattaaatcctacttcattccttttgttcaaagttcagaatttctttatctcagcctctctcctgaaacattccttttctttgacttttcctttagttccagggacaggaagccctcgtccccaaatgaggtctctaaagatccttgccactttccttgctaatcctagaactaggtttcaaccatggatgggggggtttgtcaagaggggagagacagctttcactggcaaaaatcttgatggtgagtagggcttgattttcataatacaaggtcgactctgtgctctttctatctgaacactaggtctaaaatgccttatttaaacctgactcaagagagggacatgtccctgatggacacaaacccagtctgccccagtgacacatcctggctccctcccagctgtgcgccttcctcaaacattcaggatccttccaaaccatattcttgtagctactgctatttcaaaagtgcagggaaaatatggttttcctgattactttggaacttgtgaacacagacgcaatgctcaatgttactttaaacacatttactaacatctttatatgcttgaagcaaataaagatttacccaaatgctgctttagcatctgaaaacttgcagaaccccattttggttgctctgtaaccacacttacacagtccttgctataaacacacgagtctggtttttcttctgcaaatatgtatgatttctgtttagctccatccctccttgatttttctgcctttgcagactgataattttgtagttatctaaatggacaaatatagccagaggaaaagatcctaaatcagttttcatggctaaagtgcacacggaatccattttggcaaaaagcactcaaattctcagaattcctctaaatccttaaatgccacacggctgtgatattcctttgaagacgagcattggacctaataaaccgaacactggaggcacagatctcgtcttctttagttcttgcaacagcttttcactaaattcaaaaaagaccttttgtgcttaactgggttttcatttcattgcttttaaatttgttaagcttgacttttgacactttgggtgtttagccttttttttttttaaaaaaaagtgcaattatataataaatatttgtgcttccagaaaggaagacattcatctgttattaatgctcgtatacaaagaataaaatgtacttcactcttttgttagaaataacccacataaatatgtacatttttttaaaaatcatctttaaacaatggcataaactatttttgaaataacacacagaaacatggtatatacaacgtattcactccactagaaggtgtaaacaaaatataaaaaaaattaataaagccaagaaggaaagataacttgtataaataattatgtaaataaaatgtgcctttgaattgctatgtaaacaaattagacatcaaatgataaaaagcacagttagtaaattacgattctctataaaaaatatgaaactatttgacttttcccattgatttactttcccagttcacttcagcaaatgaaaaaatatgagtggagacggctctcagcagctaaaatatgaaaacaggcatttgtttttgtttttcttttaaaaaaatgtatatgcaattttagttacttctcagaaattacaaaagggacatttaggaattgttcacaaggtgatgctttgagattaaattttcttttgatacgcttttaaaaatattcagatacacagttttgaaaatattcacctcttaggtgaggatcgtctcaatctaatagaaatgttttttttccttttctgcctaaaggaaaatgattttaaaattattttctgaagaaatattgcatggaaatcaatatgaaaaacagcattattagtaagtggaacataattcttaaacattttagtccacttattttcaggtatttcaaatatatttaaaatatttttcatatatatttttatccacatcacaattcttgttgggtgttaatacaggttctttttttctttaatgtcaggaagaaaacggcagtcatgataggaagacaatatttacgtttttctatcttctttagtttagttccaaatccaaataaataggaatgtaaaaatggtttaaatggttattttagaactctgcagggaatcttctctttaaaactatttcaagccttttctaaagatttctcacatcagtattatgttgttggtttccttttgaaaaacactctgcttcttaaagaaccttataatttaaatgtatttcctatgcatatggttttgtcaaaatcccagtccaaacacagaaaatgccccgggtctccttaacacctccaaagctaatgtttataggccagcttaaatctgagcagaaaatattcaccacaactcctggcttttttttcttctttttcttcttctttctttctttttctggatcggacgagcgctacatttgatatagagactgattttttttttttcccatcaaaattacatgagaagcaaaaagctggaatctaaggctctagacaaactgggtgggtctcctcactcctgtcttttctcagtgtcagactctatgtttagataaaacaatttatctttatcattttcaagctgttcagacgggcgaggggtgggaggtgcgaagggtggaggggtgagggaaaaggtgattgtttcacttgttgtcagagggcattgatcagccctgctgtctgctggtctccgaggtgaggccaggtcccccaggagtacttcggggctgggccgtgtcagggcaaagctgtattgagtcatgacccagatgacggctcattgaggcaaacgggtattggcgtccaaatcattctgagacaccctcagtaacacttaaaccagtccactccgttaatgtcaggtcacgggggacacatttagccccctctgctgaccattagaccctttgatggagtggacgataaacttgacgggacaagctggaccctgcacttgagtctgcctatgtttacagtaggcccagtgtgaggctggcctttggagaacgcccgccgtccctgtggccaggtcctctagggactctggcccttttacaccacacaggataaaacagaactaaaactagttttaatgttccagcgtcaaagggagaaaaacaagccaccgtgatccttcgcaaagtttttcaacaatgaggtcagatacaaattgtggatgaagtggtctggctctaccattttgtaatttttatttcttgctttgatttttctctttcttctaagcaccgcttatatagtgcaggtattttgaaatccatttgttataccttctgtggcaaagaacaaaaagaattccttattgtttcccagggaagtagagaagaattcaacaaaaattcactctgttgtgatcataaggtttccagggcagtcttctgaaagggaattattttattttgtattaccaaacatcaaatatattttggggagagaggggaataggaatctaaagctaattgcatttcccattgatgggagcattagcctaaaacaaacttgagcttggaaatgaatctaaagtacaaactaacaaaaaccaagtctttgttaacattcaaagggtgaattaataatcattattgctactatttaaacaaattatacctaaatcttctgttacacgagagattgctactgtttacttttgctgctttcccaccagcaaaacggcctctggtttgacagagcagattttctggtattaaaacgcttttatcctagttttaacaccttgtctgaattcctcttgagaattaactgatattgcatgagaagggaaaatgcgagggggttttcaagtggcccccacactcaaaaactcagttcaacagaaacaaccctcccttcttcaaacaataccagttactaagtacacaagtagcatgaagaaaaaaaaagtacaaatgagctaactaatatgaccaaattatgcatctgttttgtcttaaaagtaaatatctaattaaaaagataatctagttaccaaactattaactgtccttctgataaataaggaagcagctgtgggttatgtttaaccaagggtgagggaggtgtagtcactctcaggttctcattgactactttgcattatccaaacctgagagacttttccagagttcatattctttgtttcctaatgcagtctggaacctctagagctggctaaaattcagaagtgtttctcttaaaaggagtcagtttatcaagccataaagattacatctcattttcatatcaatgtacatagcttcattccagagaaactggataaattagaacatgtacccacagcccacttgattacatcctgtccctgaagcttgaaagtaagacttatagattcagagacttcaaatgatttcagggagtttatattttggtatggttttggaagaggtgttagagtaacttgttttctttccatgtgctattaatattgtgtgtataatgcatacatataaacaagtatcatcaacatttactaactccatcttgatgttttatgttgaaaggatagagataattctagcatagatgtgtctgtgagtgaatgagtgagtgtgtgtgtgtgagagagagagagacagagagagagagaaagagagagaaagcacacagtcatgtatcttttactcatctcatccaaatagacttctaactacagccctaactcaagaaataaattgcattgatctggtatttaaaatggggcaatcttgagtttttagtgggacgagataccagagggaaattacatcattgccagtaaacttctctctccaccctgctttcggtaatttttcccacctcttcctttcaatttgcaaagtcaagcaagagcctaatggagagaaatacatacctattatgccctgtacatgtttttggcacctaaaaagtataccattagtaattggaaaaattagccataaaatccatattgactaacatcgtgccatttcattcaaaaatgatcattctatcctgatccaaatgggcagaagctcaaaaggtgtaagacatagaatccatgaaattaataaaatcaccttgattttaaaacagttagaaactgcacttccacatttacactctcattttctcaccaccactagcattccaaataaaaaatcagtagacttgggatgggttctatacaaccacaaaatcttagatatttttctgaggactagaagactgaattttctctgaactctgttctcagaggacatgagtgtaaatgagggaagaaaggcattttgttcagtagcaaaagaacattaggtacctgtttgtcatgctgcatttatattgctttttatgtattaaaaaaaccttagattttcctgctctagactgatacgtctgcctgtaaaattcttggaaaataacataccagttaacacgcaaccagtaacacctctgaaggcagctaattctgaatttaactcttcttgtgacctaagtttccttctcgggattttcattcacatccacagtctgagtattccaaggaaactttatccttcaagcaccttttgtcacattctgccgggctctgctaactgtcctaatcacatcgcctgtgaattggatccaaggggagacaagcactatgtatgccatttgctcattggctccatgagaaaaatcaaacatggacattttactccaataaaccaatgtttcccaatgttttaaattgctacctggaaaagaagtcgtgtaactcctttttttttttttcaaaatagtgtctgatgaaagagatcccttatattttttgtttagttttggatttcaccttaatctcaacacattttgaaatggctcattgaacttcattctctgagctctagctctctagaggtcacaagaaggtcactaggatattctctgaaagcatcacatgagataaaaatatacagattccacagtttcaacactgtcatcagggactctagcccccacgacaccaatgtgtgacagaaaacgatctcccttctccatctaaaaggtgagcagagtccagaccagggctctggtctgtcctttgaaataatccttggtccctgtggtgaatatgatgaaacattggtatctcagagccattttccaatatagtccaaaccactggtcacctccaatgtcactggtcacaacctctttatatttaaggacagcatagactggtcatgttaatctgttaatgatgtcttaatggcaacccaaaattcaaagccgacttgaggacacgatggggatcccacctggctagatagcaccatagactccaggtctgcctccaagtgtagggtggggaagaagggtcttttcctgcttctaggtgccaggcctagggtttctcccacctagggggtctaaggaagaaatggattttctctttctgttcattgtatttcatcatctgatcactgaaatgcttaatgtgagttttcagaaaaagtagggcagatgatcagaaaaagtgataaatggcggctgcatttcacacggttgtttataacaaactagtctgaactgctgcaccaggagtcacagtacaaggggggaaatgtatgcaggcaacagggagttaagtaaataaattttttcttttcttcgtcaatgtgtttagttctcttcctgccaagattcatctcactctgctatcttgtgagagacacatatggtgcggtgaaattgccatccaagaaagcatgtcccagcctgttgagacatcatcaaataagattaaagcaaagtaaaaataaaaagatagaacgatttttttttcttttccttgtacagagaacatctgatgaaagccactgaggtacttgaattgcttctaaaggtttgcagccatttctttactctggatggttaagaaaaagccaggaataacatgacaatatcttctttgcattctccaagttagtgaaaaaaaagtgcttcataataaaccagacgtatatgaataaaataccatcttgccttcagcacttcagttgcaaatagcacttaaacgcgctgtagacagacctcagtcttcactttcccgccttctctttgctttctacagattcagacttttcagggtggcatagaataaaactttcatttttaaatattagttattaagattccttttatggcaaactgtggctaatttctggctttcacagacctcggaatgggaaggactgagtttcatcttcagcccgttggtggtcatattttcctgcggtggctgacacactcaggaggcgtgggatagaaggtgacagcttctgctactcggtgtccctgcagttgccagcctcccagggactctgctcacctaggaaggtacagcttcccttattctcgccacctgattccattaggcccaatgtctactaggccgggatattataaatagacctgaccttcctcagtgtctctgtacctggaaataccctgctggtacgggtatgagttagctagacgactatcacggccaactccagaaggcagcatctttcccacccaatgccccctaagtgaagacttacagtcatatccaatttctttccctattcccttttatctttaagaatctgctagctttgggagaatttatgaagggagcgggaggtgggggaatccacatgccactctcttaagactcttctagaacattgaaggcagttcgtattttattttttttgaggaggagtctcgctctgtcaaccaggctgcagtgcagtggcgcgatctcagctcactgcaacctgtgcctcccgggttcaagcgattctcctgcctcagcctgccgaatagctgggactacaggcacccgccaccacacccggctaattttttgtatttttagcagagacggggtttcacagtgtcagccaggatggtcccgatatcttgacctcgtgatccgcctgcctcggcctcccaaagtgctgggattacaggcgtgagccaccgcgcccggccgccatgtttgtatttttaagaggctctctgcccctccgcttccctccccagtgggatttcaggaagtactgtaaactctttgaaaggatgcagttggccgggtgccggggctcacgcctgtaatcccagcactttggtaggccaagatgggtggattgcttgaggccaggagttcaaaaccagcctggccaatatggtgaaaccccatctctactaaaaatataaaaaattagccgggcgtggtggcgggcacctgtaatcccagctactgagcaggctgaggcaggagaatcactggaactcaggaggcggaggttgcagtgatctgaaatagcgccactgtactccagcctaggcaacaagagcaaaactccatctcaaaaaaaaaaaaagaaaagaaaaggatgcagttacgaggtaaacaataccatgcttcatatgggagggggcccaaagccaggctttgaaattaaattacattttgtttaagtgtctagagagggagggtggcaggcagtgaaagacaagcatgtccctttcttaaatgcagacacagtgttttctgtgatgtgaagtcagtttgtgtttctaagcagagatgaggaagcagccggagcatttgtttgcaaaccgttctaggtaaggtttacaagatcttgtttccgatgtgcggccttaattggacctctggaaagcaacaatgcatcagtggaagagattatcactggccttaataagctgttgttggctttcataacagccactgcctaaaatgaggcacaccgagcccagagacaatcttaccaattgcctggagcaaggattaaagcaacaaggatccgaaggagagaacgaaaggagtggggaggggggtggcggaagaaacaggggctaatgtaaaatcgtttccatattaaccttcttcccttctgacaatggtcaagttctgattcaaaatacaaattatctccaattacttcaaaagaggcagtcagagagctgtcatttaaccttcaccatctgtttgcttcaaaagaaagcggtacagcctgccacattgacctcaactttccctcagagctctggacggcaccaaagatggaagcttattgtcctctgaagaaaaatctactggggttttcagggtggcagggaagcatggggagggttaggaaagaggataaaaaggatagatgttacagggggaccaaaggaaggagtcctagggggtgacctagctcaagctgaggtgatgtctagagtggagtggggggcttacccatcctggtcttctttactcaacatcctccactagaggatgtggtttaaaataagattggctttaagaaggcctcagtgaggccgggcgcggtggctcatgcctgtaatcccagcactttgggaggccgagacaggcagatcacgaggtcaagggatcgagaccatcctggctcacatggtgaaaccccatctctactaaaaatacaaaaaattagctgggcatggtggtgggcgcctgtagtcccagctactcaggaggctgaggcaggagaatggcatcaacctgggaggcggagcttgcagtgagccgagatcaggccactgcactccaccctgggggacagagcaagactccgtctcaaaaaaaaaaaaaaaaaaaaaaaaaaggcctcagtgagctgagacagctgaggaccccaggacaggcaggatgaatgaggcccatggtgtggccgggccttttgcctggtcttctgtcatgggaggccaacaaaggttgcctggtacaatcaaagaagcaagattgaaaggccaaggagagtagcgctttgggaaaataaacaatctgttagtactgtactattagacccttgtgttacaggaaactagtccggacccagacctcaagagaggattcttggatctcacacaagaaagaattcagggcgagttcgtaaagtgaaagcaaatttattaagaaagtaaaggaatgaaagaatggctgctccgtagacagagcagcctgagggctgctggttgcccatttttatggttatttcttgaagatatgctaaacaaggggtggattattcatgcctcccctttttagaccatatagggtaacttcctgacattgtcatggcatttgtaaactgtcatggtgctgttgggagtgtagcagtgaggacgaccagaggtcactcttgtcgtcatcttgttttagtgggttttggccggcttctttactgcgaactgttttatcagcaaggtctttaagacctgtattttgtgccgacctcctatctcatcctgtgacttagaatgtcttcactgtctgggaatgcagtccagtaggtctcagcctcattttatccagcccctattcaagatggagttgctctggttcacacacctgtgacacttggatgggctaaaaaatgaaatctacctgctcaaccaaaacccccaaaagcacaccattctggagcctctctgtggaagcacgacatctcagtctgcatcaaagcaattatacctcagaaaaccaaattccatcatctacaggggtcccgaatgggccttccctccttcggaaatctagcagagttaaaggaagagagaacagcagtttatgaagatgtcccaggacaagactgaaagcaccagtagggagaatggcttcccaacaggccacagtgaaataatagagtgcaaatttctaaatgcctgcattttatgggagatttctaatgtgtgtgcccacgtacattatattatttccactacctctgatctttattttccattttacagcccactgaataacaggttttttcaagagagaaagaaagaaaacagatcccctataaatgaggacaactttgactcgtaaacagttcatgcgctcagagaggaaaggcacctggtactttctaaaggaaagcacctccaaataccagcaccatgtggtgggagggcaatgctttgccttatcaaatggtactgaagcttgaggtctgtttctaccaccacgcctggagtaactgtcagggcctcttatttctcatagccaaagcagatgggggacaagtcgattaaacacagaaagctgcagtgctgttattaagcagtatcagcacggcaatgacggctggagggaccacggtgaagggcgaaacctaaacctccaaggatgggctctgcattcacctaaagcccctccccccacacgcacatacacagaagaaaatgactctttttttttttttttttttttttgagacagtctcactctgttgtgcaggctagagttcagtggcaccatgtcggctcactacaacctctgccacctgggttcaggtgattctcctgcctcagcctcctgagtagctgggattacaggcacctgccaccatgcccagctcacttttttttatttttagtagagacagggtttcaccatggtggccaggctggttttgaactcctgacctcaagtgatctgcccgcctcagcctcccaaagtgctaggattacaggcatgagccacctcctcctctcccttctctgctccttaagcactcctctttttgtgtgtgtgtgtgtgtgtgtagagacagagcctcactctgtcacctagctggagtgcagtggtgctatcacggctcactgcagctttgaactccggggctcaagctatcctcccacctcagcctcccaagtagctaagactacagacacataccaccatgcccagctgattttttttatttttgtagaggcagggcctcactatgtttcccaggctggtctcaaactcctggcttcaagtgatcttcctgcctcggcctcccaaagttttgggattacgatcatgagccaccacaccccgtctcccagcaatttccaagtacaagtcaagggttccattggcagctcactgaaagacactgcgtttaggtgatggcattagctgtgcaacactgggctttgatgaaagcaccctctttcagatcttctctcaggcctgttcatcccttccaagttcagcttagaagatactgggccacctaatgagttgtcagaagagcgaacaatggaaatgaaggtgcacatccctctctcgggtccggttgctgcatctgatataagccactgtctctgatgggtatctgccctttcacacacgcttccttgctggccagtgcaaatgttctatatttgagtcaaacatagaagacgacacggcagaacttcttggaataaagaggtctttggcggactctggctctaccctgtctctctctctctgccaccgtcccctccctggtaagggaggtagggacagtgggaaaatcattaagcagcagcatctggacctgattaattaactagctggagcatctgcaaacgtgtcaggcctgagcctaggacaaagtcctgtgagcaggtttgtgttcaggaagggaaccggctgttacattttataagacaaatattatctgttcttcttccaggatgcttgttattaaaagctggatttaatagaagaattaaaagggcttgtttcacttgacatttcatccactaaagacctgaggggggaaaaaaaaccccagtgcctgatgatcgggagcttgtctgtcaagttccttctctgttttgctttcattgttttccattgactggtttttgcaccaaatgttaaagtcataagatgctgaagatttcccagttacaggaatcttttcaaggactatttcagagaccgcaatgtgcaagagatgctcattgctaagtaaatatcacactaaaaatccagatcttcctccttccgccgctgacatacaggtagtggaggaagcaaaaaaggacccattctcaggcccatttgtgttcggactggctaccggctcccttcagaagtcgacgccattttatcctaaagacactgtcagggctgacttttaaatgctcttttgatgtcaagattcacacggatttgatgatcgttttctacacttagggccctgtcgctcttctcttatattaccccatcaagttggtacttcataaagcctgaatcatcattactatcatcttaattgctaggcgggtttgggtgtaaatccaggtctggaggataaaatccctggggaattcccaggtgcgaagggagtggcccagactggggattcagcagcaggctgtgaactacctgatcaataaatagcacgtggactacacgagtactatctgtgatttaaagataagatctccataatcaggagatgggaaggggatacagctgtgttctggttcagagcctccgaaatctcacttgtgtgagtcgctgctacttaatagcacctcaggtcaaagacaggccgagttaaaacactctgtgagactaggaggtggtattctgttccttatttaaaagacagagaccttggaagatttagccaaataggcaaaaaagtatgagattagtgaaagggaacaaacataatctaaattgatccctaattagggccaccacataacatacaggaagtattatataaagaaataatatgttaaaatattcagtaaaaagatgttctgtatttgggacaagcttctactgaaaagaaattatttgttgattatctgaaatacaaacctaactgggtgttctgcatttttatttgctaaatctgacagtgctgcaccagatttgaaccagtatgattttcagagacaggagactgaaattctagaattttccactgacagtggacattaggcaggtaacgttttaagtttccatccgtgtgcagatgggaactatgcattaaggtcattctgcatgaaatatctgcatttatgaattttttaaaaaaatattgttttaccacttttactgcatatacaattatctaaatctccaaaaatgaaagaaccatttctaagtagaaggccttagaaaagatatgcagataacaagagttaaatacttacatatcaaatttaattagctcaaacccttaaaaacagtttaattacttttgctttaaaatgctccaccatattttgccacagtccaaatttagaaaattagtggaaaggtaacagacacctaaactttctcttaacaagtcaacttatcataaatttggaatttttcaagttcaaaataactagggtttattattcttatactttactgaagacaactaactctctcccagtgatttctttctcttttcccttctgattacaacaaaaatccagctacctaaaataggcttattcctcaaaaggaaacaaaactgccgagttctatgacaataatactaatcaaaagtccattttaattgttccgggccctcatagtgtatttgatctgtctctgtgggcatcaggatgactgggctaagctgtgggggcctcctctccactctggagcagttttgcatttcaactttgaaaaatgaaaaacctgaatgcacctaggttcctaacttgggaagaaagtgctgaaatagattttgtttaaaataaaagagctctaaaaatctacagagtaactcttttgagacaagcgaatacatgttttagcatccaagtgggatatagtcattaacatcctccttcaaagacagtctagtcaatgtatctgctgcagcaaaatatttgggatttgggcaatgcattttggatctgaatattccctaggttctgccaagatagcacctaccctaggaatttctctgtcaaagtcgtcactaaaatgttctagactgaaggttgtgccctgaagttctgaattgcaaagggccacagtggtgtgtccatcttaagaagtggctatgagaggccgggcgcggtggctcacacctgtaatcccagcactttgggaggccaaggcgggcggatcacgaggtcaggagatcgagaccatcctggctaacacggtgaaaccctgtctctactaaaaatacataaaaattagctgggcgtggtagcgtgcgcctgtaatcccagctactccggaggctgaggcgggagaatggcgtgaacctgggaggcggagcttgcagtgacccgagatggcgccactgaactccagcctgggcgacagagccagactccgtctcaaaaaaaaaaaaaaaaaaaagtggctgtgaaaagcctctcttcattcacttgtctcaccagagaaggcagagatgatttctcccttttgaaagatggctttaaaatgacattgagagggtcaaaaaaaaaaagaacagacaaaattatttggaaataaaaaagagtacaggcaaatcaaatgtccccatgtttttaaaagcctttctatgaaactggtcctatttattagtggtgaaatacaaaccatgctatcaagaatcttaaggaaatggattgctgttaagtgatacttcagaatccaccccctagcaaggctactgcgccattacaggaagataagcagaaaatccttgcctcccataagggaaacctttgcttgaaatacgtgtaaaccattcagtggcagttctaaagccagtgattcaaaatattgctctggaaaatttcagttaaccagcagtacccagggtctttacagacgaaaacaaagaccaagactttgtcaagggaggaggtgctaaaggaggtgggcagcctctgaaagtgcagtctttttttgttttttttgttttgttgtgtgtgtgtgtgtgtgtgtgtgtgtgtgtgtgtgtgtgtgtgtgtgtgtgttttgtttttgttttgtttttgtttttttttttgagagggagtctcactctgccacccgggctggagcgcattggtgtgatctcggctcactgcaagctctgcctcctgggttcacaccattctcctgcctccacgccattctcctgcctcagcctccaaagtagctgggactacaggcacgcgccaccatgcccggctaatttttatgtatttttagcagagacggggtttcaccgtgttagccaggatagtcttgatctcctgacctcgtgatccgcccgcctcagcctccctgaaagtgcagtcttaaaggtccaatttttacactcattaatattacatgtaataatctacagtattagggatgtgattggttcctgcctggctctgtgttgcgtgaaacagcaataatctaagtacaacatcacttcctatcctcccaccctccacatcctgcagtcccccatccctgcccttctacctgtcaaaatgcagaaggaaactgattaccacctggaacaggttatgctcctagccttgcgttcttagaacattttgttttggagtcctaggattctttttatcaagagaaaaaaaattttaaagtatagacaatatccttgaggagtttgtaatctaggtgggaaggcaaaacacccaaagaaaaatgatgcaataatagcatcttggatgaagactgctagatcaacttctcaagggactcaaagcatttctttaaaatttcttcataaaaaagaagcaagtgaatgagttaattcaaaaatggcttcaattgaaatccaaagcaggacacacactagggatagaccataggccaagcctaactatggttttgtcgctaggtcagagcaaggactagcgagggtgagggagtgtttgcttcctacctgtcacaagtctccatctagatgtgtagaaaacatttgacctctgggtttggttcagcctctccctatcctgagtttgtgggaaatagacggccacgtatcatggtcaccatcatcctcgctctctgcataaccccaggtgccctgggccaagggtttggtgcctgcaggcttgctgagccacagcttccgccgattccatgctttgaccccacgctggggtttacatcccagttctcatccaaaatgctagcccctgcttcatctccattatccctcggttctatcccttcaagatgggccttgctttctctacgctcaaattatatcaagcatcctaagatgtaagttccagcatcactacatgggattccagttattgccaccattatctcaagactctggctccttgactgcctctcttccacccatcttcctgcatccctaccccagccagagcaaactctgtacaaacaagggcatagctcagacccaacatccccctgtattctataatcaggccctctggccaccctgagcattagaacttccaccggctctgttttccagcctgacccactcctactccctatacttcaaaattgtaccactgaggtctctacacctagtgttcaagtctgctcaggttataaaaattagatggtaaattttccaaaatgctgtcatctccacgtcatgttcttaaatgctggtagctatgcaatgtatttaactttgaggtgtctctttgttctcttaggaaaaaagcaaactggaatagatgggtttggggatgcctctaagtcgtcatgctttctgagtagtaagaaacagtatgaggccaggcacggtggctcatgcctgtaatcctaccattttgggaggccaaggcgggcagatcacctgaggtcaagagattgcgaagagcatggccaacatggtgaaaccccatctctactaaaaatacaaacacgtagctggatgtggtggcacatacctgtagtcccagctattcgggaggctgagacaggagaatcgcttaaactcaggaggtggaagctgcagtgagccgagatagtgccatttcactctggcctgagcaacagagccagaccccatctcaaaaaaaaaaaaagacattaccctcaaatatttgcatctgatgataattctaaggaagtagtgaggttctacaaaacttatcaattttactctttagtttcacattgatggcatcaggaagaaaaccccgatgaattcttcaatggcctctggtccattctgtaacgtagaacttctaaaactcaagagtagtaacttggacacaaggtggtgctaaggggtaaaaaattaactgtgcgtccttttcccgaaaggttacctcgaatactcaaggttttcggggcacttaatagtttacaaatgttttcacacacattgtcctgtttattcctcagactcagctagtctcgtgttctaaatatataaatgagaaaaataaggtccccttaggttgtgtgacttgtccaagataactcagcccaatctggatctcccttctaagtctaggtttagtgcctttttttactctcctacacaggttagtcccttttttatgtgaagtaagaattctcaatagggcttccatcaacatctgccaagctagggagttctgaatgcaccgatgcaacttacatcctgtgcctcactcgtgttgctagtcaggggaccagtggggtcttggtgactctctctgtgttctcaagaatccttggccaaattctaggatttaaaaagtaacacataaaaatttgggccgggatgggggggatcccaaggagaaaagatgagttctgacgatacttggatttagatccacctgggtagaagacccctggtctaagcttcctgctcatgcagagctgtggcaatgctgtagaaacactagcctgaggctcccagagcaccctctcctggtgcagcctcatctctctcctgatagggctgaaggtctgtctccacatgcgggcaggaaggccctggtcccaccagtgccttcatagccatgtgtcatataagccagactgagaggcctctgcagatggcaagggaaaatcagatggcttctcctgttgagatgatctcctcatagacctaaaatacccacaatgggtggtacatttctggctgtatgagtttcccagagctgccataccaaattcccacaaactcagtggcttactgagtgtattgtctgatagttctggaaggcagaagtctgaaatcaaggtatcaaccgggctgattccttctggaggctccgagggagaattcattccatgccacactcctagcttctggtggctccggtgtcctttgcactccttggctttgtagactcatcatcccaatctttctgcttttatgtggttttccccagtgtctctgtgtgtcacacatattcctgtggcctcaaactcctgggctcaagcaatcctcccacctcagcttcctgagtagctgggactataggtgcagaccatcacaccaagctaacttttttttttttttttttttttggagacagagtttcactcttgttgtccaggctggagcgcaatgggtggcgcgatctcggctcactgcaacctctgcctcccaggttcaagcagttctcctgcctcagcctccagagtagctgggattacaggcacatgccaccacacccagctaatttttgtatttttagtagacacggggtttctccatgttggtcaggctgttctcgaactcccaacctcaggtgatccgcctgccttggcctcccaaagtgttgggattacaggcacgagccactgcacccagccaacactgagctaactttgaaaattttttgtagagataggggggtatccctttgttgttcaggctgttgtcaaacttctgggctcagacgatcctcccacctcagcctcccaaagtgctgggattaccgatgggtccctcttgttttttgtttgtttgttttttaataagaacactagtcattggacactaatctcctaaatccaggatgatttcatctggagctccttactgattacatctgcagctccttactgattacatctgcaaaggccgtatatccaaataagatcacatgctaagattctaggtagacatgaattctggggaaacactgttcaatttcaagcattcacaacttttcttcctttgaactaatcctccaagttctcttcctctgaacttatagaagatggagaacaatggtcactgtcatccccagaagagctcctcatctcccttagttgggacatcctgccagtgctttctctaccaggataacaccagccctcttcaactgcatttttctctacacacaacattctcgtttgccaaggtcattccatggaaccaatgtccagcgtcttctctttccttagatcccacagtccatactcaacctccatgtgaagacagagaatatccttttgagttggaagggatgttgactgacttcatccatttattttgttctcattccgagtctggatttgcctgcgtcccttgtagcttaagagcccttttaattaagacatgactcacagatcatcttcatgtcaacaggcaacaatattgtataccttcgaatttttcaataacgagccttgaacagaacaaactctttgtttcagtgaaaaatgctaattgaaagatttttttttctcaaaaggacattgaacgtaaaccaatgtactaagcaaaatgtagatgatgcctctccttttatctgctgttccttcaaacagaaaacaaagtaccaccccaaccaaccaactcttctggcaggaaaaagaaagagtcctcaaattacgttcttcaacaaagggtcaggaaggaaaagtgaatgtcacaaacaccattcaaagcaccgcagaaagtagtcagtttggtttctttcagaggctggaagaaaacgtccttctcccccgtctccctttgtttttaagttactaaattcctttacgtttgttttcttaggaaagtgacattataggtcattaagcaactattaaaaacacaagtgagaaaacccaaagcgtgggtctttttcctctgatattcttttccctggttttcagaaaacagttttaagagttggaatatttttgttaatgtctttgtgggcatttccgtcatctttccatttgtaacagcccctaaataaggcagctaggggaaacctgccttgtcttagcacacctgctatgccaaaacaggaacatgcattcccccacaatgggatgggtgatttgccaaacagaccagagctcccaaattacctgcctttttgcagtgctacacccaaaaatcaacccgttgactgatgaaatcaacccgtgtggaacttgattttcgacgtcctctcttcctcccacagttggacaagaaaggggaaggaaagagaaaagggagaaaagccctcttcccaccgggtaagtccaggtgagtcccattcaccaccgtcattgccattgtgcgaggctgcagcatggagctggcccccctctagccacaggatcgagctggcttcagagcttccggggtctcatcctcttgcaaatttctttggtggtgaaatctatcaaaggaatctcaaaacagattacatggtaaattatcgtctccattctgggccactctccatgccccgctgtccggctccgacagacagccgtgggtgagctgccggtggaaagcctccgagataagaagattacagaatgtcatgtgcctccggcgactcaacttcacagctaaacttctccagcccaggcagttcatctgattcgcatgggtcacaggctgtttcaattaatgcctctctaatgattcaagtgtgtgccctaatgtggaaggggaatagagagaagtcaagccagggaccttagcatgtctgtcctctccaccctctatctcagaatgctctttcccaagctgacttataagaaaggagaaaatgggatgggaaggaatatagaattcctttcagacagaaaccttttatgtcaccttcctgtcgttaccaatgcaattctgtgagtcttccgtgggctgtggatcctagagtagtgaataacagccctgatacgaaaacagaatgcagaaaacaaatgagcattttgaaaataaaaagcctggcttttaatcctattaagatcatggctgcttttttttttttttaatttctctcccctgccctaaaaactccgaaagagataccgatgttcccattaacataaatgctgaaatcagcatttcctttgaaagaagttgttaatatttggaaatggtcagatttccaatccaagctttgattgttattctatactagccagcaagtgccaaggtcacagggagattcacctgcagactgagctaaatgaatccactcggccacaatgcatgtataatttaacagtctcctcttgagtacttccatgcattcctaaaaaatattttattacaataacaaattggtttcaaaatcatgcattatgtattctgaaattaggtctgccagtgaaacctggatgcacaaacatgcgtactcctgggcagggccggaagagcacacagatgccaggatggagctcaagaacagttaatcccacaaggaacccactgtcgcttctttattatcttaatctgcatatttggaaagtaaaagaacaaactgatcatttactgtaaagggcaaccacccgtttcccttaatcaccccctccatgagaaggcagagggcgtgaagtcctaaaaataggctgccgaggcagtttcccaagctttccttaaaaaacagttattccttgaatattaaaagtcttcttttcctgtgatctgacacttcccgggtatacattttacaggaactggactttaacaaagcttctttgaaacattaaagataaagatatcaaagccatccttacaaatttgtgttaagaaatacacttgctctgccgtaagctttcatcactgagttacccaaaaaaagttaacatattcagaaaaatccttaggattcccgacacaaatgcaaccccatataatgtgtccctaatgggtgcttgtttctgctttgcaactttcatctgaagttaaatacacattgatttagcattcttttacaacatggggatggttttctcatggcacaataaacatgtttcttaagatgtctatttgtgaataattaagactaaaatgcttttctgattccttcctagttttttctagtttagacctttatatcacacttgtaaaaattccatctcatcaaatgaatggcattaataaatcctaagcaggcaggttttccaaaatggcgactttcatgatatggaaggcatttgatcttaaaaacatgagaaagaaatttagttgagttttctctttgaaaagtttcttgggcatgagcttgatctttctatattaaaagaaaaaaatctagtttatttcaataggggattggttttcattaacttgcaagctaaacatcattggtatgtttctattggtgtactgacttggtgaataaaacaacaaattcttgagagagtcacttataaatctctttaaattaaaatcagtctaatttttattataagactaacatcatgataggcttagtatttttaaggcaatgcccagaactaaaaagtttaattccctgacaagagcttttaataaagacaaatcataactaaaattagatgctgcaaccttttcttctcaaaaaaaaaaaaaaatctgcaaacactgtgttaagacatcattcctccttaattttgtttcgatggagtgatatgactagacatatagcttttctatagttaaattataaagaataattttctctaatctaatcagtaatttctaaaaatgggaaatggtaacagcataattttttatttcttttgtattataatttaggctgacacattaaagctttgcttttcaggggaacaattaagaaattgttgatagaaattaaacattactgacaattgaaaatgcatttttttcctcattcgcagcatctagatataccgctcctacctcccatcaaagataatctaagctcagatagtattaaagtaaaaatgaacgaaaaagcttagttcttttgtgctaaacaaaaaggtgatttatataagtaataagcaaattccagagtatggagatatatgtgtatttttaaatcctctaaaaatgccttaagttgtaatcttcaggctaaatgattaaactctctctgggtcctttggctgtagaactatatccttcatgttagctgtgggctattttcggctgaatgcaaactgcttttttgttattaaagacagttcatgttttacaccacctttggtgtatggtatacagaccaacacacataatttaggtcagtattaaaatagaattaattttttttaaaaaaccttcaataataattacaataattacatttccttcccacacattgcaacaaatagttacatagcctacttcttaaatactggtgtgaaaacactaagtcgaaattcatgacacaaatcaaaatgtgttgcacaaacttctttttggttgtcgtgaaaggggtgtctcaaattgagtgtagaagggcattccaataaccatagtactttttttggctgaactgtaaatacataattcatatattaatatgataaaatatataagatcacccatatagtaaaaattaaatcagtgaaaaggactaaatacagttacaaataagcagcccagaagttctaagggaaaatgccagaagtcaaaatgctttctgattcatcttaagcagaacaggagttttaacacaagcctctcttaacagctacccaggcaggatttgaggagaataattccctaatgccacttaaaaaagaaaagtcaaccgaaagcatcaaatggattttgaatctaaatattcttaaaaaaaaaaaaaaaaaactttttctgaattggcagc

SEQ ID NO: 381 - DNA, 114268 bp, Homo sapiens
aagttccttcacttcgactattacttccttttcacaattctattttggacttctgtccagtgtgtatttacaggtagacaaagctttttttctttctttctttctttctttttttttttttaacaacctctttgccatgactgaaaagaagcctgtatatcctgcagtttctgggcattgtgagtctccttttaaactcaaattggtgataatggtgactgtgactccctattgtccaaggaggggagttgcagatagggccttcaaagatgatccaataaaaatcagtgcagtaagactttttgataaaatgatctttatgatgtagaggcatttggaatatgggttgggtactggataccctggggctaagcccagtgtttaaaaatcaaggcttactacgaaaaggtctgtttttattagtgcaggtactgtagttggcaagatttcttcttatgaaatgcaatatccagcagaccattcctgattatgttatgtatttttagatgttaccattgagttatatttatagtatagactactgaatcttatcttaaatatgcaaaatatatgcataactaacctcccaagctgcgttccctgctctatattacacccaacaatgtagcctgttcttaaatggttctcctaaaagtcttagaatggagcttattatttgcttttaaaatgtaagcacagagactgtgtgttagatgtgtggccttctgggtgacatgttctgctcctagatactctaagggtgaagtcagcaaacctttggcagtgcaggtggggagtgaaaccaatagtcttgcatagataactccccagagtccagaatgagccaaaagtaattgatatgccagtctttgccagcatgtttggtgaatcagagcagcaggtgtctgttacggtattggggaaggttaaatcaccgactgcattgctgatgtggctcttgcttgtgcccatcagcttcccagtccccagaacccccagagtcctagactctcatcattctattcctcaggacaacataaatattatcaggagcactgtgagcacagtcctgcttctgctacttaaagttgaagggaaacgagtatccttacatctctgtatcccatgttcccctgtcttcatgaataagtggtttgattgttttgaggccaacttgagtttatagagcttgtctaataaaaagatggatgtccttggggaaaaaaagctgaggctaataaggtgagagagaaacggaatcctttcaatgagctaagaaattacttcaattgaaaagcctgggaagtgaccctatcttggtcaacatatttcatgggcaaggtctggggatgtctggtgtcttcccaacccatgaaggcacccatcccacctgggtttgccctttctagatggtggcccatctcaaggatatttttctttctttctctgatccaaatccaaggactatgttctagtccttcagaaatctatactaacaaactggataagtgattctgcctcaaagttgcataactacagaatcattggtcaagttcttactgcctgctcacttattcatcaggaacttattgtgtacctgccatgtatcaggtactctactaggtgtgggggttacaaagatgaatgtagtgcagtccctgaactgaagaacatagtctcatcatggatgaaagtactccactaacataagatacattattattgtctaacatatgtgatgttattatgggtatggtacaagatacagtggaaacagagatgagaaagctgatcttttacttggagtggttggctaagaattctcatttcagtatggctttaaagaattcaagatacggctgggtgtggtggctcacacctgtaatcccagcactttgtgaggctgaggcaggacgatagggataaattgtttctataaaaaaagtaaaaatgttaggtgggcgtggtggcacacgcctgtagtcccagctactcaggaggctaaggtgggaggatcacttgagcctcggaggttgaagctgcagtgagctgtgatcacgtgagacaaactgataccctatctcaaaaaccaaccaaccagaaaaaccccaagaattcaaggtgggagatgcagaaaaggtaatagtatcctttgcagacagagacacaaaagcatggacacgcgaatgatactgtgcaggaatagtcaggactcatagtcagctgatatgttttagtaaggctccaccagtgcttatacaggtgttcattctgagtagcctgtgcctcggtagtagctaataatgttgaacatcactctaggagtaatcacagattgcctgaaaccataggggttatacatgagggaaagaaggaagaagaaaaagtgggatgaaaggagaccagttatgaaggcacttgaataccaactaaggagctgtgtgtcaccaaattgtagttactgactcattcatttatttatacattccctggaggcagggataccagatagaagactagattaagaatccaatcaagaacaaacaattaattgagctaaggcagtattaattgaaatggaaaggaggattcagataagaaagatatttttaagaggtcagtgttctgactctggtgactgtctatggtaaaagcaagaaacagagaaatgaaatagaatctaaggtttccatattgggtaacagtgtgtcttgtatgtgctcagtaagggttgttgaattgaacacaatgttaagagcggttttctaatgcttttctccaaagttgaaattacagcagaatttcaggttctaaggcatgagagagagagagagagagagagagagagagagagagagagagagagactgaggatctgatgaatctcttggtgttcaacgtgttggcacagtaagcatttcccaccaataaatgatctgtatagtgattgtgataaactgagtttttgaaggatactctatggaggaaccatggttaatgtctcaatttgagaagagaaggacctgcagataagtgtgaatggctgtgtagactgaactgtacattttggcttgccctagccatgagaaagatatatcagatttaaatagacaaggtttttgttacctacatagactataaaagcgttctgcttttttagtagcacactatccaaaataatactaattacccaaaagtggggaaaaaagacaactgtaataagctcagagtatagttaaaaaccaaaatgattattgtgatgttcaaggaacatgaagtctaagtcaaatttgaaagcttctgttgtgagttgatttgtagacttttatggcaaattttggattcattgtatcatgttttgtgactgagtttgatctattcaatggcttgacaggtcctttagtaaagaagacctgtatctcaatgagccattactgaagttgtaatgagtagataggcaatgtcttgatgttcatacagctctgctcaagtggtctgtaattccttgcaatgccgcgaagaaagcactgggctaagagttacaggatcagccctccatttgccagccacatatctgtaaacaaatccctgaacctctttacacctcagatgccttgtttgtaaaatgggaataataacagctgattcggtataacccaaagggctgttgtgaagatcagaagagatactccatgtgcaatttctttgtgacatataaagctctgctgacttgtgatgctattactattgagaaggccacataggtggaatggttaaaggacctatggaagaccactacgtatgatgttaaggacagtaataggctgggacagtgaaatgtggtagtgccctctcttttttctggctgcatgggtaagctgagactgcaggatgtcactgtcttgagttgttgctccgtgctacatctgaatatattacagtagtaacgtactttcagagagctgacaaaattgtagtcagagatgatctttttgaagcaaaggactcttagtcttttattgtggatttatgtagctcaagggatatagttaagaaccaaaataaccattcctggatcttaagagacaaaggattcatagcagcagttgtttttgctgcacttgtgtttatctccttaaatgtgcacgaatatgtatatgttttttacagcatggggaaactcatgttaaaattcattgaaaccattaattggaagcagatatacttctattacatgttttgataatctgtatttacaaacaatttgtattatttttctattcttttttgttatctacctacctgaaggcgagtttcctattatttctagttcaggcttataagaatgactaatatatgaggggaacttctaaacagtctattactctgcagcccatttggataaagaagtgtgggaagatttgagaataagttccctattgtcatcaacacatgttgaccactgacccttctttcttttccaggcaacttaaagtggtcttaatttgtataaaattatatatcaattttgtccctaaaaggtgtggatcaggctgctaatctgattttgtgggtgtgaggagagggaagcatatatagcctatgatgtatgaatacatgtgatgtgcacatatgtacagcagatccatatccctgaaacattttaggagaactccttaaatgaccatattctacttgtgcagctgtggcagtaatgataactttggtttaatatggattattggaaatggaaatgcaataaatggaaactagtgtatatcaatatagaaatgcctattcattttcattaaaagagtattcagataacattttcataaatgttagaccaatgtgtcatgtggaggcagttattaaaaagactgaaggcaaggggagttgtttaactttaaaaaagacttgatatttgtaagtcaaatttatatttccatcccagatttactctgcaactcaggtttggagctgtgaagtcaaaacccaactattacatgcccagccacaaatcagcatgtcatggagagttgttgtgtgtgtttttgtggaaataagtgggagaagttaactgctgttgaattgttggaaattattggttaaatttgagttatatttgcaaatacacaagtatcaattgtgcaaagtgacgttaaagatgaaaaagattttttaaaaatcacactaactatgcccttgatggaagttacctttcagagctgcttcacttacattctctaaaggtttcctgttgctttctattcgttattcttaatttaaaatcaaattgtgccattgagaatcaagaatgtatcaagagcatttacaaaatgtttcagactacaatgtaaaaaagtaagaatgactaaatcttgaagctcacacttgtcaatttaggatagtctataaattcaaattcaagtaaatttaacttttattttatttacttttaattatgaagcagatagcatctcagttttctcacctattaggtccagggtgagaggagagagttacaagttatctattagcatggttcttatgaaagtaatatcagatatggtggcatgtctaaaagcactttgtaactataaagaacagtgtgagcaatgtttgtatttattattattattatttttgacacagagatttgcttttgttgcccaggctggagtggagtggcactatcttggcccactgcaacctctgcctcccgggttcaagtgattctcctgcttcagcctcctgaatagctgggattacaggcgcccaccaccatgcctggctaattttttgtatttttagtagagatggggtttcacaatcttggccaggctggtctcaaactcctgacctcaagtgatgcacccaccttggtctcccaaagggtgatattattattatagtaaatatcacattgaacaatttttatctaaaactaatgtcagaatgtccatttcttgatataaaaataaaaaagtttgcttttcatttttatctttctgtagagatgttgctttctcattgacacagaaatcaagactgttcagatgatgttaataaaacagcacatcaatataatttttgaaggagatttataaaaatgtacattttaattgtcattaaatcttaatacttattgagcaccaaggatgtgatgagaagtagcctgctaggtctaatgacactacttagctgtttgaataactaaatagcacatttctatttagagaccatataagtattataggtattcttggtgatgttataaagttcttcaaagaaaatatgtatttatatctggctttatatattggggcaaaaatagcaataacactttcaaaatagtgacggaaaaacgagtcacaataaatacgttggattctgaagataaaggagtatataattctcagagttacaacatctgtctataaaaatagtgcaattgggatatactattttagtaagaaactcattaagtgtaattttaaaagctgctgcttttttcttaagtttgacattccagtaaactcttaggaaaatgtccttccagttgcttttcctctaagtgtctagaagtggaagtacattaaaattaaaagcagaaagtcccttaaattccttttaagaagtccatcctgttagtctgactcctagaaaggctatggttgctattactttgggctggaacaagattacaaaagacctcaagaagaagtggaaattatcatgggagttttctgtcactcttatagtttatggcctttttgttctttttttagtccattaaacatttctttttgccaagaggtcctatctgtaaaaggaagtctttgataatgatagtttaaaatgctatgtaatgagatacttatatgcaaaaatccaaaaaagcttttttatttctataataatgataatagcaaacaaattatagtgaacagtaaacaataagctaattataattatgtgaattgctttctccctcactgattccttctatacctattattttatttctctgttcacaatattcctgtgctataagggagactgctaaatttgctcttttttagatgaagacttagagacctgtaaggttgatatgactgcctcaaagacacatggtcgcgctgtggctgagtcgacactcaaggccagttctctgtgtttctttttcagtgtgacttgatatagcttgtatcttaaacactgcatttttcttatgttctaggtttctcctctgccaacccctcctggaccattgtcagcagttgaacgacaaaggctgtgaatctgcatcctagtcttagcagtccctctgattctcatgatgagctcacctgcacagcctggtcagtctggttgcttcttaaactgttaatagacttcatgtgaaagatgttgctttgtgttgtttcaaaccaagtaatttaatttatgaaggaacttttttttttttggacaaagattgcttaatgtaacaaattttgaattttgcattcgatagctaattctctattgcttaacccagtttgcttcctggacaactgatttgatttgcattgtagtctgagcatgggactttaattcttctgcttccaaggtaacattcagattgaactttatgaagttatgaatatgaactattatataggaatccatttttcacctgtaatctttctgtcctaacatgtgtctgtatgcttttaaattatactgtggggctttggaagtcagtttgtggattgactccacctccatctctttgacacacaggaaggatatttttcctccccacccttctttgctgccattcctgtttcctatatacatatttaattataatctcagcacctgcttcctcctattccagtgatgtgtgctgctcatgtagtgctgtgatcagcacagccaacacccgttcctccaggaacaggctgtcatttttggagcaaacacaatccaagttttgggaatgatgaagtagggtcagataccacatactagtaacagacaagttttacaagaattttctgcttggatacttacagaagcatttatttctttatagattccttagcatattgatatccttggtttattgaactaagttgaagcttatgtactatcatactcagggcttataagggagacaacttgccaagattttcattccctggattgccacacccaagttagctgtttgggaattccgctgtttcatcaacctttccccacatccccaacaggcctccaacttgtatgctgaatttggaacttgattctaaatggtgcagtccagaaatccctgagtctttagtcacaaccatgtttgataattggcatgtcactaggttaggcagatggcagttacttacttatgcctgttagctctgagtctttattgcctagtggttctcaaactttagcatgcattgacatcactcggagagtttgttaaaacaagccctattctcatagtttttgatttcgtaagtctagagtggggcacaggaattgtgatttttacaagttcccttgacaatgctgttgctgcttggggaccacactttgggaatcactggtttagcttcttctgcccatttctcaccccatcccctaccagcctctacagacaaccttgtttaagtgtgttctgtgagcggcattgcttattacaattatagtctagtactattattctttctgttgggatgaacttaaattaacatttaccttatataggtgtatattgcattttaaatattatgtatatttatttgtatataaattcagtgtttcaaaattggattgtttaaaagaggcattaatttagaaccactgtggtcaagtatttttttcttgtgataatatttggcagtggatgttggtctaccctgctccccaagaatgttgattttataaaatgaaaatctcacttgaagctgctattttgatgaggaaattcttgcgagttgtgataattgttcagttatgaggagagaaaaggtgatggataaataagacaaccattgaatgaagctcacttgactttagggtcaccaaaatttcctcgtgtacttttttcttataaatcattctgctgtgttgacaataacattatgcagaagtctcaatcaactccatttgggaagtttttatgaatgaaatctgaagttgaggaaagtgatagtaaatgtgccaggtgggtaggagtttcttctatttattgcaagtaaaaaaccatgatcagagacctgaaattcactttgcatggataaaggaaaatgttcctgccacaaacataaaaaaaaattttctcctgttattagcctgcatcttagggtgccgtatatattctgagaaataacctgattgtttgatttagaaaaaaatatgtttttcttacatcttttttccccactatctaaaaagagaattaaattggtcttatgcaatcatcatccatttattttgcttttgttccacaaatggctctaaggagttattgtgcaccagaaagaaaaatagactcacttcagtagttccagaaattctttaatagtccatgtttcagactgagtatgtttgtcttcaaaattggttctggtatagtgtgaattcttatttttcccatacattaacatcattcttagaaacgttctccatccatattcaaatatggttgatatgaaatacaaaatgccgccgtcttaatcatgcattcagtcaaacaataagtgctgatttttgtatataaaatttactagtttttattttaattttgctgcccagttctgttcaaagttagagccttgggtattgcttttgggcactgaggatcctgaatggaggaaagactatctggataagattggcagctagctgctgcagttgagctcttcattcaaaacttattaagcatctaacttgtgccagccagtgtgttacccaatagggacacaacaagcactaaaacatagtttctatccttagggacagcaccctttcatgggagagacaaatagtaatagctttagtccatttagtgtcttaagtattttaataaatttaggaccagaaatttatttcctctgtacagcagtatggatactatttctagtaatgtaatttttatcagaattgccaaatctcagaaggaaggattttaggacttatctagcattttcaaaacatgtcagatagtaaaaatctcctgagacttgttaaaaatacagatttccagactcctccctgaaagagtatcgtgtggtagcctgggggaaggatactggattgtagaatgtatattgctctttgctatgacttggcaaagtgtagaaatgctcttagtccattcaacagcactagtgtttcatatttggagactataaacacaaaaacacatcataaagtcttatctcaagtaaatgtttctcttgtgagcaaaactatgctaattcagttattttgttctctgatgatagataaataaaaagctaacactggctaggtgcagtggctcatgcctgtaatcccagcagtttgagaggcctaggtgggaagattgcttgagccccggggttcgagactagcctgggcaatatggtgagatcctatctctacaaaaaattttttaaaaaattgcttggcatggtggtgcatgcctgtagtccctgctacttaggaagctgaggtgggaggattgctcgagcccaggaggtcaaggctgcagtgagtgagccatgatgaagccactgcactgcattctagcctgggccacagagcaagaccctgtctcaaaaaaaaaaaaaaagaaagaaagaaagctaacacagtggaaacctagagaaggcaataatttgaggggaacattctagtggctttgcgtctatctaggccatctcatttttatggggaggtggatggaccaaagagatttttatggagtgcctttattttcctcaaaagaagtttaagcatattttaacccagggcagctttttagtccgatctcaagattatagaaaacctaatttcagcctgaacgtttttaaataaattgggctacatcaaccctaacatgatttttaaatttgatgaatctattttttgtaattaattttgatgaaaacgcatccaaaggaattttccaagcatagaacacaatgtgcctgttgcccttagaattgtgcaatgctctggccttgtgggcttctaggtaaagtggccaaagctgtgttgcaaagtcctgtaacattagttttcaaagccccttgtataaagctagctcatctctcttttcaccattgtgggaagtactctactcatatgaagtgagaggaccaagctatttatagaagtgaaaggtttatagcaagatcttatattctgttcattttctcgtattctattcattttcttattggcaagtcttgggcaaaaattaattaagagatttatcttcatgcctctgttttgctaaacagctgaattcccccatagaaatgtagagtacatgtaactaatgatcaaaaagttctttgaaatataaattgttatggaaatgctaagtagtataaacaatttgggggcaagcattaataaaagcttctctgcaagcatttttaaagaggactaataaaagcttcatggttcaattaatacagcacaacatcaggttttttagaagcatatgggacccagaaggcctgcccctgtttttaaaatttacgaactctttaatgattcaccatttttactccagtgcattacccacagtggtgccatttagccattaagtaggaaactaaaaccaggacaaagctacaaacaaatatcataatgtccaagtgggtattttttcttcagtttgttcatagtgtgttaccaaaaaaatgaatgttaaatgaaacagagtcttagggcaaatcaaataggttatggcttccctagatgagtatgatcagttagctttttaatgaaatacaggtcaaatcccatgacaagtagctctacataactaaaatattttcaggccactggccaattatctatttcaagtaatattcaagaaaattattccaggataataaaacaaattagttttttgatgtttgttgtagcagaagttgatcacagggtatggtattaatgggaaacactgtatgttaaagttattaactattgttttggatttttttttttttttactactttaacttcacagttaagtgattcattcttttgccatttgtaagtcaaaacttctcaatctgatattcaagtttgaaacataaaccaaatgaagcattttattcattctctagtttttgaaggacagtgctttaataagtgaggcataaaccttttctgaaaatgttcagtataaatttgttttgaacatttatttgtttttatatttgcttttcacaattaattttggtgggtaattcaacttatataattttcattattgtaacactacaaacaaactccataatgcaggccaaacagaaaaggttatttctcgttcatataaagactgagtagagagctgctgtttttctaatggctaccctttgccccggacagcttctaactggtttgtgcttcttcagttcatgtattctaaggtcattgtgcatctccgcatcaagctggtgggagggaaattgaagaggtgcattgagtgtgagaggtttccaaaggtacatcacttttgttcacatttcgttgagtggaatttagccacgtggccatacctaactacaaaggaggctgggaaaagtagtctagcagtactccaggaagaggaggagacaggtttggtgaacagctggcctctctctaccacatttgtcttaaaattttatacctaggactgcagatacggtattgcttaccaagaggtgcagtattttataatgcactcttgatttaaccagtcattaaaaagttaagtaattttcctttgaagagattgaaacacattaaaatcagggcagatcagctcaccaacatttctaagagttgcctaagcctttgtttatgaatcatgcagaatagataatgcccagtgtagctattagaaaattcaagttcctgttagtgggaactctgcagaaaatgggagtaaaatgtatgctgaatattatatgtccttaattagtgtttaaaaataatgtcaatttatctgaaattataattgcacatatgctgaggaaaaagtactttaaactttataatcacaattcttatgtttgttctttattgcattttggggtcacgtttttcaacacctctgtagttttaagtattatgatgaaaatctaggccaaatatacagtggttgataaatacttgttttacactgatcttttcatgaacactactataaaacaatgctagactatatattttcttaagccctgtaagcaaaatcttgctacctctgcaaatacacatgtacagccctttgtttataacattatgtggaacctttatggaggatttttttgtctgtatagattggagtttactcttcagagtacaaaaactctgtgtgtgtgtctgtgtgtgtgtgtgtacgtgtgtggtgcatgtgtgcttgtgttgcagtactataataactctagggaaacacaaaggtatgtggaaccatgtaacctgtacttttacactaaatatcccccaaggctttactttctgtggttttctgcatatttcttaatttttgtcatattttgagaatgtcaacgtatagcagttttctccatttataattcactgcctctaacttgttgtagggttagaaagctaagaattgtgttaaataaaattgttaaaagatcacaagttctgaggaggtgcaaatgtcttgtttttttttttttttttttgtgtgtgtgtgtgtgtgtgtgtgtgtgtgcgcgcatgtgtctctgtgtgtgtgttttaaatagagttttgttcttgttgcccaggctggagtgcaatggcatgatcttggctcactgcaacctccgcctcttgggttcaagcaattcttctgcctcagtctcccaagtaactgggattacaggcatgtggcaccatgcctggcaaattttttgtatttagtagagatggggtttcaccatgttgctcaggctggttttgaactcctgacctcaggtgatccacccacctcggcctcccaaagtgctgggattacaggtatgtgccactgcacccagcctgcaaaagtattttttatgaacaaaatagaagtacttgtttttcttacatactgtaattgcattttaattgtctccttatccactgcacccctcttattttctcggttcttctgtctttagtctatagatttacagaattttgagtttccagcgggtgaggcatcgttatggttttaattttgccatacttttccttgcagttatgatacatcagtttttttttctttttttttaaattatactttaagttgtagggtacatgtgcacaacgtacatgtttgttaacataggtatacatgtgccacgttggtttgctgcacccattaactcatcatttacattagatatttctcctaatgctatccctccccctgtcccccaccgcacgacaggccccggtgtgtgatgttccccgccctatgtccaagtgttcttattgttcagttcccacctatgagtgagaacatgtggtgtttggttttctgtccttgtgatagtttgctgagaatgatggtttccagctgtatccatatccatgcaaaggacatgaactcatcctttttatggctgcatagtattccatggtgtatatttgccacattttcttaatccagtctatcattgatggacatttagattggttccaagtctttgctattgcgaatagtgccgcaataaacatacatgtgcatgtgtctttatagcagcatgatttataatcctttgggtatatactcagtaatgggattgctgggtcaaatggtacttctagttctagatccttgaggaattgccacactgtcttccacaatggttgaactagtttgcactcccaccaacagtgtaaaagtgttcctatttctccacatcctctccagcatttgttgtttcctgactctttaatgattgccattctaactggtgtgagatggtatctcattgtggttttgatttgcatttctctgatgaccagtgatgatgagcattttttcgtgtgtctattggcttcataaaagtcttcttttgagaagtgtctgttcatatcctttgcacactttttgatgggctgggttgttttttttcttgtaaatgtgtttaaattctttgtagatttgtcagacggatagattgcaaattttctcccattctgtaggttgcctgttcactctgataatagtttcttttgctgtgcagaagctcttcagtttaatgagatcccatttgtctattttggcttttgttgttgttgctttcggtgttttagtcatgaagtccttgcccatgcctatgtcctgaatggtattgcctaggttttcttctagggttttttttatggttttaggtctaacatttaagtctttaatccatcttgaattaatttttatataaggtgtaaggaagggatccagtttcagctttctacatatggctagccagttttcccagcaccatttattaaacagggtatcctttcccatttcttgtttttgtcagatttgtcaaagatcagatggttgtagatgtgtggtgttatttctgaagcatctgttctgttccattgttctatatctctgttttggtaccagaaccatgctgttttggttactgttggcttgtagtatagtttgaagtcaggtagcgtgatgcctccagctttgttcttttggcttaggattgtcttggcaatgcgggctcttttttggttccatacgaactttaaagtagtttcttccaattctgtgaagaaagtcattggtagcttgatggggatggcattgagtgtataaattaccttgggcagtatagctatttccaagatattgattcttcctatccatgagcatggaatattcttccatttgtttgtatcctcttttatttcattgagcagtggtttgtagttctccttgaagaggtcctcacatcccttgtaagttgcattcctaggtattttattctctttgaagcaattgtgaatgggagttcactcatgacttgactctctgtttgtctgttattggtgtataggaatgctggtgatttttgcccattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcttgcctgattgcgctggccagaacttccaacagtatgttgaataggagtggtgagagagggcatccctgtcttgtgccagttttcaaagggaatgcttccagtttttgcccattcagtatgatattggctgtgggtttgtcataaataggccttattattttgagatatgttccatcgatacctagtttattgagaatttttagcatgaagggctgttgaattttgtctaaggccttttctgcatctattgagataatcatttaatttttgtcattggttctgtttatgtgatggattatgtttattgatttccgtatgttgaaccagccttgcatcccagggatgaagccaacttgttcgtggtggataagcattttgatgtgctgctggatttggtttgccagtattttgttgaggacttttgcatcgatgttcatcagggatattggtctaaaattctctttttgttgcgtctctgacaggctttggtatcaggatgatgctggccttataaaatgagttagggaggattccttgtttttctattgatgggaatagtttcagaaggaatggtaccagttcctctttgtacttctggtagaattcggctgtgaattcgtctggttctggactttttttggttggtaggctgttaattattgcttcaatttcagagcctgttattggtctattcagaggttcaacttcttccttgtttagtcttgggagggtgtatgtgtctaggaatttatccatttcttttagattttctagtttatttgcatagcggtttttatagtattctattctctgatggtagtttgtatttccgtgggatcggtggtgatatccccttaatcatttttgattgcgtctatttgattcttctctctttccttctttattagtcttgctagcagtctaccaattttgttgatcttttcaaaaaaccagctcctggattcattgatttttttgaagggttttttatgtctctatctccttcagttctgctctgatcttagttatttcttgccttctgctaccttttcaatttgtttgctcttgcttctctagttcgtttaactgtgatgttacggtgttgattttagatctttcttgctttcttttgtgggcatttagtgttataaatttccctctacacactgctttaaatgtgtcccagagattctggtacattgtgtctttgttctcactggtttcaaagaacatctttatttctgccttcattttgttatttacccagtagtcattcaggagcaggttgttcagtttccctgtagttgtgcagttttgagtgagtttcttaatcctgagttctaatttgattgcactgtggtctgagagacagtttgttataatttctcttcttttacatttgctgaggagtgctttacttccaactgtgtggtcagttttggagtaagtgcgatgtggtgttgagaagaatgtatattctgttgatttggggtggagagttctctagctgtctattaggtctgcttggtgcagagctgagttcaagtcctggatatccttgttaactttctgtctcgttgatctgtctaatattaacagtggggtgttaaagtctcccattattattgtgagggagtccaagtctctttgtaggtctctaaggacttgctttatgaatctgggtgctcctctattgggtgcatttatatttagtatggttagctcttcttgttgaattgatccctttaccattatgtaatggcctgctttgtctcttttgatctttgttggtttaaagtctgttttatcagagactaggattgcaacccctgttttctttttgctttccatttgcttggtagatcttcctccatccctttattttgagcctatgtgtgtctctgcacgtcagatgggtctcctgaatacatcacactgatgggtcttgactctttatccaatttgccagtgtgtgtcttttaattggggcatttagcccatttacatttaaggttaatattgttatgtgtgtatttgatcctgtcattatgatgttagctggttattttgccagttagttgatgcagtttcttcctagcattgacggtctttacaatttggcatgtttttgcagtggctggtaccggtttttcctttccgtgtttagtgcttccttcaggagctcttgtaaggtaggccaggtggtgacagaatctctcagcatttgcttgtctgtaaaggattttatttctccttcacttagtttggctggatatgaaattctgggttgaaaattcttttctttaagaatgttgaattttggcccccactctcttctggcttgtagggtttctgtagagagatcagctgttagtctgatgggcttcccttcgtgagtgatctgacctttctttctggctgcccttaacagtttttccttcgtttcaaccttggtgaatctgacaattatgtgtcttgggtttgctcttctcgaggaggagtatctttgtgatgttctccgtatttcctgaatttgaatgttggcctgtcttgttagtttggggaagttctcctcgataatatcctgaagagtgttttccaactcatttccattctccccatcactttcaggtacaccaatcagatgtagatttggtcttttcgcatagtcccatatttcttggaggctttgtttgtttctttttactctttttttctgtaaatttgtcttgttgctttatttcattaatttgatcttcaatcactgataccttttcttccacttgatcgaatcggctattgaagcttgtgcatgcgtcatgtagttctcattccatggttttcagctccatcaggtcatttaaggtcttctctacactgtttattctagtgagccatttgtctaatcttttttcatggtttttagcttccttgcgatgggttcgaacatcctcctttagcttggagaagtttgttattactgaccttctgaagcctgcttctgtcagctcatcaaagtcattctccgtccagctttgttccattgctggcgaggagctgcgatcctttggaggagaagaggtgctctggattttagaattttcaacttttctgctctggtttctccctatctttgtggttttatctacctttggtctttgatgttggtgacctacagatgggattttggtgtagatgtcctttctgttgatgttgatgctattcctttctgtttgttagttttccttctaacaatcaggaccctcagctgcaggtctgttggaggttgctggaggtcctctccagacgccgtttgcctgggtatcaccagtggaggctgcagaacagcaaatattgctgcctgatccttcctctggaaacttcatcccagatgggcacctgcctgtatgaggtgtcattctgcccctgctgggagatgtctcccagttaggctacatggcggccagggacccacttgaggaggcagtctgtccgttctccaatctcaaacaccatgctgggagaactactgctctcttcaggcctgtcagaaggggacgtttaagtctgcagaagtttctattgctttttgttcagctataccctgcccctagaggtggagtctacagaggcagcgggccttgctgagctgtggtgggctccacctaattctagcttcctgagcactttgtttatctactcaagcgtcagcagtggcggacacccctcccccctgccaggctgctgccttgcaggtccatctcagattgccacgctagcagtgagcaaggttctgtgggtgtgggacctgccaagccaggagtgggatataatcttttggtgtgccatttgctaagactattggaaaaacgcagtatttggttgggtggtgtcccgtttttccaggtaccatctgtcatggcttcccttggctaggaaagggaattccccaactccttgcacttcccaggtgaggtgatgccctgccctgcttcagctcaccctccatgggctgtaccctctgtccaaccagtcccagtgaggtgaaccaggcatctcagttggaaatgcagaaatctcctgtcttctgtgttgatcacgatgggagctgcagactggagctgttcctatttggccatcttggaacggaccagtccatagttttataatgcatgcctatgtgttgatttgtgttgctttggagttgctttaatatccaaatgaaagactcatgaccatattattggtgaacttttaaaaaatattgtattgatttataggaaattgataagctttgaggtaatctgtaaaattatttttaacccccccccccctttttttagaataacttcctggcacttgattatataaggctcttgctgcttatgatagatggttgctcctcacatatcattgcataattaaccttttctcccaggctcttaatgtccaagaaaatgttctcttcataccagtaatgtagttccactggaaagtgttctgggtgagctggggatttttcctttggagctggaatttgccctagtaattctgccttctttggaattctgtgagttctgtgagagggcagataatcatagtggtgtatgaccaagcactcaccttttatctttaactctcagaagaaattgtttttcagaaagaaatgtcaaaatgacattattcatgagaaaaactagtcatgagttttggactctctaggaatgtaaacatgtttaataaaagctggtgacagtttttcggtctgctgttactggaaagcctgcttgatttccttccctgtgtttttctggtcttgagatctccagtgctttctgaagatccaggaatgccgtacaaatgggaaaagccagactgttatcttgaacctctgtttttgaaatctctgtctgataaggaaaaaaatattgcaagtcattgtagttacttgtttggtttgtcactggaattccaaatatttgcttggtggttcatggacatgtaaattttgggatatgttactattgtttagggtatactgtctgtaaaataagttattaacccagtgactgttaactagatcttccaaaagccctgtctcctatcattttatgtgtattgaaaaattattataattagagatttttttaaactcttagaaaatgaaagtatacagctatgaaaattctgtttgggtaattttttaaaaaatttattttcagttcagaggtacatgtgcagatttgttatacaggtaaactgtgtgtcacagggctttggtgtacagattatttcatcatgtttggataatttttatgttattttttaatgcatttttatccttttgtctgtattattgtgcttccttttttattaaagaagagttggatgtatcttactttggctttatgtttaaagtgaaacagtaaattgaaagattttaacaggtcgtggtatgtcaatgaaagaacctagaaattagcagaaaaatgcaggaagccaactatagatattggaaaaataatacataccataacttgagttaggtaatgtacactatcgagtctttgaatttcaataaagtatgtcaaagtagacattgtatgtcattttcccttctgttgggagaactgataatccgcctacccatctgccttcctacctttcttagttttctttctttttcttttattctgcctaagtccagaaaagatttggggtctatataagtaagttatggaaaataaaatacgtgaggaggaagggaaatgaagggaaattgggtacaccctgttagtacctgcatttaaattctgtgaagttgcttgaagacggatggatctgtgtctgagcttcctgattagcaagtctgttgtctatggtgcgattaatctcttctcagcctaactctgatatagtcactgccctgtataagaaatgtcagtggctctctatcacatctatttaaggtatataagaacccgtacccttttcaggcttatcttatttttctcctcaatgaaccccactctgttcaacatgtagagctgcttaccttccccaggtccagttttcttgcttggaggcctttgaatgacccttcctcaccactgggagtgtcctgtttacttatcttcaacacccagctcctactccattcttctgtgaggccttcctgggtgacgctgacatttgttacctctctcagttctggaacttaccttagtactggggttgtcttctctaataggcttagctttttgagggcaagggacatctaagtacattttgtggggtgtatatagagtgaagcagttggcagctgtatttatggttgctctcttagttaagtaatatactgcccagcacacaaaaggagccaaataagtgaagaataaagggcactttgtgaggaggctgattatagtggtgctaggggcatggaattggggaggagggaagcagttgaatatacctgagcaaaaccaaactgtttcatatgtgtcatgaatcatatcccttttctttttgcttattcatttgttgactttcggttcttttcacctctagtgctatccactgaacttcctccatccccctacctccccttccctcccgttccctcctccacctcccctcccctcccctctcctctttgacagagtcttgctctgtcacccaggctggagtgcagtggcacaatcttggcttactggaacctccacctccctagttcaagcaattcccttgcctcagcatcccgagtagctgggattacaggcacatgccaccatgctggctaattgttttgtatttttagtagagacagggtttcactatgttggccagacttgtctcgaacttctgacctcaggcaatctgcatgccttgggctcccaaagtgctgggatgacaggcgtgagccactgcacccggcccccctctttctaaggtggcttatctattcattgaacaacaaacattgcaatagggtagtcattgtttgcaagacttgtggtttcatactgagttctctaaatgtggggaagttgctaagtttggctcttcttcagctagcacagcggtagaagcagacctaccaccctctttccttttagtaacttgaacttctccctgtttcaatgcttataaaccacctctctcccaaaacaaatatgtattgtggttaagaatagtggaaagagtgacatgatttttaattgtggttgagcaggaaattgttttaagttagtttagaattcattgatccaacattctttatacttttaaaaagtaatacagttttgcatactgtataattagcagtaacttttaaatatactacgtttctgaggaccttcagtaaaatacatagaaaggaaaacatccggcttaaaatttgtgacttttcaatctgtatacattttcagttcctcttatttaaagtgatagactaataaatattttaatataatggttgaagtctttattaagattaaattaggatcttaaactttctgtgtgtctccattaaagatgtgtttttggcttcattatttgacagtgttgtggtatggcatttaatggagaacaagatctcttactttggaatgtatctggtcaaatggagttcctttcatatttgcccaggaagcttatttttctaaagattatggaaataacagatgtggaacaagcaagcactgcatgtctttcattcagagttctctgaggaaccaccttgggtaggcttttgtttgtcacacacatagcaagtatgtctttaccctgactgatgcaatagtccagcctcctgtggggtatcatccactaacaataatgccataacccattagttgattgcaaactctctgaatccatagggacttgccccagtccaaatgagtgactaattcttaaactacaaggtaaagctgaggtcctaagggaggagggacatgttaaggtttgactgtttattttgcttgttattactgcaggatcattaaagaaatgtttatatcctgttggggttctatgttcttaaccactatataaggatgaataagctttgttttttttgcttctacctctcttatatttctttccattctctaccctccctctcctaaggaaaaatggtgttcacactcattgggtctaaataaacccaaacgtcttttctttgaatattttattaccttatctgtttatctattaatgagaaattatacaaatgcatatttgaagttcttagtaaaagcccaaggacttaaacgcagctctggaaacacctgtcatctatcttttatttagtaaatctccctttgtcccagattcctcatttggaaaatatgtcatgaatttgttatgttggtatcataaaagatgtaattgtacaagagatagtaaagtatcacatgttcatttagaatgatcacacataaatatgtgcttttttctctcaaccgtgacctgtaactatccttttttgaatgtcacaaaaatctcatgtctataagcctctccacactgatgagattgaggcctaaaaccatcatctcccagctctgtcacaatttccagatttgtctctgtctttaggtttgctcacttttgagcacatagaattatgccatccttttcaaattacatgtcagctccttactttatcctacccccagtagtgagcgccttagttgccttgcttcatcttttgatgtgtttttacactgtttgtcatgccagcatttcttgtgagcaccctccccaagacacatacacacacacacacacacacacacacacacacacacacacacacacaccacattcttaacctatggacatttgctgctgtaaattcattatatatggtgcattgaaaatgtttgctctgtgtttctttctggaccttgtgctagcaactttgttttgtcatttttgtcaagtgattttcttttttcttttttttttccaaatcagctaagtcactgataagattgatgagtatgagagattgatcattttacaatttccatcctgcggccatatgagaggttgtatttggtacctagattagatcaaagagtgtcagaactcaatgggctgtataacatgtggcaggtagcagagtaaattggaaagaataagaataccagaaggagccaagaaatacctgttggaaaccccaatctgccctaactaactttgggcctttgagaacaagttactttatctctctggatatcagttttctatcttgtattagtttcctgtggctgctgtaacaaattaccacaaacttggtggcctaaaacaaaggaaatgtattttctcacagttccagaagccagaagtccaaaatcagtttcactgggctgaaatgaaggtgtcagtaggaccttgctccccacaaagactccaggggacaatctgtttcttatctcttctagcatctggtggctgctggcattctttggtttgtgactgtatcactccagtctttgcctttggggtcacattgccttcttttgcgtgtgtgtcaaatctcctcctccttcactcttatatgcatatgtgtgattgtattttgggaccacctggataatctgagataatctccccatctcagaacctttaagcatgtctgggaagtccttttttttccctaagaggtaacattcacaagttctagggataaggatgtgggtatcttttgggaggttgttattcagctactaaacgcctgaaataatatctgaagtcatgctggcttggcttgtaattgctattcatttcattcatttgttcattcaccaaacttttatttcatgcctaatatgtgccagacactgttctaggcaataggaataacccactgatcatgcctttagtaaattcattatattgttggtgagattaccatacagaataaatgctaaaataaaggtaaaagagacaatttagactattggattaattctttgtatgtctccttttgcacagttctggagcacaagccaccagcatgcctcagtacttgtaaatcatttcagtaactacaaggattatgtgtagtgtagcctgtggaccagaaagtattttacagaggtcaaagcacgcatcagcttaaattcaattcaggtgtatatattgagtacaaaaataaagtttagacctccaccacaattatacaatttttgtcaaccctggctgcacatcagcatcaatagcaggcctttacaaactactcatacctgtccccctaccccaccttgtgcttggttctaggtggagcccaggggtcctttaaaaaaatcttattagcagattcttacatgctgagggcattgaacagagagaacctgtggtctgaagaataggaaaaccaaatacaagggtactgatacaaatgcaagtcaaaatactgtaagttttctcaggatatatagaaacaaaatagtttggatactcagaggaaaatgagatcacatctggctcaagggaaatttgaagacggaagtgtttgaaatatccttgatggatgtgtaaaatttcaacaggcattgattaggggagggtggaggaaagggaatccacagaggtctggagtaggggaaaaggtgtgtgtcatggctggcagcagggcccaggagccaagatctaggcaccaattctctctccttttgctgagactttctggcctggaaacttgaagagcttgagaattctaaatttaaatctggtcctctaggtcattgtgaaggtatattttttcaaggcaggagggtaaaatgtattttatttgacaggtaataggttgatatatactttttaaaaatttagaaacatgatttctgggcttccatttgtactcttgctctatgtcgtacaagtattaggagcaggcttctgtgggggaaataaaaatggagaggaatgttttaaagtgtttcaaaagaagaatagccaatatgtgatgactgacgggaaaacagacaaacatagtgggaggtaacaaaggtaatttaaaagttcaagaatgacagtagaattagtgggagtgagacatattgatggaaaagatagctagcatttgttgagtttttctcacaagccaggggctttcactgcattttctttatgtcaatgaattattttcataagccttgaggtaggtactattcttatcccattttacagacgggaaattgagactttgaggggttagttatcttgctctatcaaggtcttacagtaaatctagctcttggatccaggtaccttaattccagagtttgtattgttaaccacagttctgctagttgtcaggagattggcttgagaataaggctgatgaagagtagttgaattcaaagacaggaatttaagaatcatcagaagagaggtcacagtcaaaaacttgggtagtcagcaagcatcaccttatcaattaaaaaacggaagaaagagagaagagtagagggacaagactaaatgtcactgaagctttcagggcagtatcttatacctgtttatggctgccagtcacttaacatatgattttttttttttttttgagacggagtctcactctgttgcccgtgctggagtgcagtggcgcaatctcggctcactgcaagctccgcctcctgggttcacgccattctcctgcctcagcttcccgagtagctgggactacaggtgcctgccaccacacccggctaattttttgtatttttagtagagacggggtttcaccgtgttagccaggatggtcttgatcttctgacctcgtgatccgcccgcctcggcctcccaaagtgctgggattacaggcgtgagccacggcgcccagccatggtttgtttttttaaaaaaagcccttgaatatttaagtaagcaaatgaaccaatccctcaatcgtgaatttttctacctgtgcttcagattctacatacataataattacgatggctagaaggagacaaatctaaagaatttcctcaacttttgctgcctgtttttgtgaccctgattcagtttcaaatccttggggatcttccttggattccattttttcaccttactccatcttttcccccacagaagatagctgcttttggaaggttatcctagcataagaagattggcagaacacttcactacttttgtcattttaaacagtttctttaatttaaatttttcatttttctgtagagatgggggtctcgctatgttgcctaggctgatctcaaaatcttggcctcaagagatcctcctgctttggcctcccaaagtgttgtgattacagacatgggccatcacacctggccattttaaacagtttgtaaactaaggtattaaagtaacaatacataaatggtaaagtatcctgggctgttgagtgtctttctcctcccctcctcttcgagtgccctgaaacttttttcattctaccattctcacaatgagtatgcataaaaagtcactattaaataatccaggaaaataaaactattgcctttaaaatatataaattatacatttttttgttacctgttattgcatgttgagtattcctcatctgacatgcttgggaccagaagtttttagattttgtatttgtttggattttggaatatttgcatataaataatgagctattggccgggcgcggcagctcatgcctgtaatcctagcactttgggaggctgaggcaggcagatcacctgaggttgggtgttcgagacccgcctgaccaacatggagaaaccccgtctctactaaaaatacgaagttagctgagcgttgcggcacatgcctgtaattccagctctacttgggaggctgaggcaggagaattgcttgaacccaggagggtgaggttgcggtgagccaagatctctccatagcactccagcatgggcaacaagagtgaaactccatctcaaataaataaaaaaataaataatgagctatcttggggatgagacccaagtctaaacatgaaattaatttatgtttcatacataccatatgcaaatagcctgaaggtaattttattcaatattttaaataattttgtgcacgaaacaaaatttgtatacctgaggtaaggtgaggaatttccacgtgtggcatcatgttggtgttcaaaaagtttcagattttggaatattttggatttcagattttcaaaataggtatattcaacttatattaaccagatcaaatgttctatgcttgtcttgttctcttgaccctcggattatttcacaatcagaatccagcatattcatttgaaaggtgtagggtattgaataaaaaggatttcagaacagctatatagttgtgtcagatattttaatattatagtactgtatttttgtgctattgtatcagagtcacatttttattaaaatttatgatttacacctaatctcttaaaaaatactgcagagcttgccttagtctgtatcctgcatgtcctatttctttttctagtactgtaattgagttgctatgtaaaatgtggtctgcctatgtaattcttcccacctaactttattaggaaaattaatagaatagcaatatcacaaaagtgtttgattagaatcatgggaaatgaaactaatttgcaataaagcccaagactggctttcaaagcaagtgatttttatggttagaagtcaaacaactttacttacagacagtgatcgaggcaaaaaaagtccatttgttatttgaaagacatcaggaaagccactgattctcagtttggactatacattaaaataacctggagaactaaaaatgaaaaccaaaagtctgaaccaggaccaccacctcaatgatactgacttaatttgacttttatgaggcttaggcgtgagtattcgttaaacctccaaggtaattataatgtgcaactaatgttgaggactgctattaaagcaagcatcaggaaagcacaaagaacaggataaagtaaataaatataaaatccttaccatttaggagatgacatgtcctttctaaaagaggaaatattgtctattaagttatgaaaactaaacttttagttctattttgaaaagagacaaattaatctcatttaaatattgttacaagcatagataagagtacatatctatactttttaaaaagccccttttttttctctttgtatttaaactcacttatcttcttatattcaagattattaaatctcagctatgggcctcgttttcccctaccttcatattgttccaacttatgaattgaaactgtacattaatttccaaatgaataatttaaaatcaatggagtaaatgggacacttgcagtcaatgaaaaaatccagcgattatctcgggcattttttttctccataaagaaagcatgattactcttacaaaatggtattttgtcacttcgtgcaaagtatcttgatcattctgggcctatgttgctttttctgtaaaactgggatatcacatattgctgaattgcagtgaccatttattgagtgttcattgtatttcaggttctaagtgtattaagtactttatatgtgatatctcattttatcagattgaaaacactatggagtaaggactattttctaaaatcctattttgaagatggaaaaccaagccttagagacttgcctagctaggttaacatgtctaaagttatatttcttgttatcgactgggccaggatctgaatttaggcagtccaacacggtagccactggtaacaaggtagcgctaaccctctgtgaagacaaatttttctgtttagctgactggttaagactaaaattaaagcttgtaccttctttacagggacgttttccaaaaagacagtcttgatatttcccaactgagcaacaggtttttctgttgaagctaacaaggaacaggtgcactgctggtgttggcatgtgccgctggcaccggacttgtggtaggatggtgctttctggtgctggttgggttttaaggaaggagcatgacactcaaaaattcccaaagcccataagactctgccccactcttcactaccaaatcttagggaaaacttcgggtagggagaaaatagaagagagctcttctggattaacatgaagtggcttgaggaatgtcaggagtgggaagccaggaaaatttgtggtcagaagaccttaattaaattcctggctctgctcttcatgccctgaaagtcactcaacttttctgaatctcagttttctcaactttaaaatagaaatgatgatgtggtaattgaattccatacttcaaaggacagatgatcaaataagataatgtactgtaaaaactctaaataaagcataaggtggttttgaaaactgttaatgttaataaaagcagatttttattttctaattggaagtctttatctctttaacatgcagaataaaagtaaaacaatatttactctacagaactacttaaattagaatgcctgtgtggtatacttggactgacttttacttccccaaagtgttcaaaacccctaggcatttaagcaactttcagtgtattagttactgcctaatgggcaaaccctatgatcttttctcagtcttcatagaattatagcagtaataatttattattcaataagtgtacattgagtacctactatgtccctggaatgggtttaagtcattggaaataacagtcagtgaaaataaaggcgggcaaaaatgaaattgtctattaagcacctaatgtggacaaagtgttacatataatctcattgaatcttcacagcaatcctgtgacataggttttactggcattacttataaatgaggatactgagggtcagagagtttaagaggcatgtctggcacatcctagcaaggagaaaagtagaactgggattaaaaccctattctatcttcttttctagcaagtggcttttcttgtgaccatttatttgttaattcatttattcatacttcactcagtagtcgtttgactttcttctttctatgaacatcacagatattttcttagccacctgtggttaaaaccatggcaccatctttaaaactcttaactctattcccctccacatcaaatctgttccaatcttgacaaaccttgtcttccatttttgttgccaaccttttgcacttattactccttgctgctactattctactagacttagaactagtctactttccctctcccctccattcagcctaatccatacagtgttgcctagtgaatcttactaaagcacaaatctaattatgtaatttctcgaaaatcttccatggcttgccatggcctacagaaattgtcagtaatcacaaggcattcctactgtcaagggtatagggcaaaccatattttcagccttcttcagtgtgcttcttcctgtgcacaaaattcatgtttcccaggcttgtctgataagaatcacctggggctaaaataattcatagattcagtggtattcccatcaaaataccattgacattcttcacagaattagaaaaaactattttaaatttcatatggaatcaaagaagaccctgtgcagccaagacaatcttaagcaaaaagaacaaagctggaggcatcatgctacctgatttcaaactatactacaagtctacagtaaccaaaacagcatggtactggtaccaagacagacatatagaccaatggagcagaacagaggcctcagaaatagcaccacacatctacaaccatctgatctttgacaaaactgacaaaaacaagcaatgaggaaaggatttcctgttaaataaatggcgttgggaaaactggctagctatatgcagaaaattgaaactggaccccttccttacaccttatacaaaaattaattcaagatggattaaagacttaaatgtaaaacctcacaccataaaaaccctagaagaaaacctaggcagtttcattcaggacgtaggcatgagcaaagacttcatgacaaaaacgccaaaagcaattgcaacaaaagccaaaattgacaaatgggatctaattaaactaaagagcttctgcacagcaaaagaaactatcagagtgaacaggcaacttacagaatgggagaaaatttttgcaatctacccatctgacaaaggtctaatatccagaatttacagggaacttaaacatatttacaagaaaaagacaaccctatcaaaaagtgggcaaaggatatgaacagacgcttctcaaaagaagacgtttacatagccagcgaacatgtgaaaaaatctcaacatcactgatcatcagagaaatgcaaatcaaaaccacaatgagatactatctcatgccagttagaatggcgattattaaaaagtcaggaaacaataagatgctggcgaggctttggagaaataggaatgcttttacactgttggtggggatgaaaattagttcaaccattgtggaagacagtatggcaattcctcaaggatctagaatcagaaataccatttgacccagcaatcccattactgggtatatgcccaaaggaatataaatcattctgctataaagacaaatgtacatgtatgtttattgcagcactatttacaatagcaaagacatggaaccaacccaaatgcccatcaatgatagactggctaaagaaaatgtggtacatatacaccatggaatactgtgcatccataaaaaggaatgagatcatgtcctttgcagggacacggatgaagctggaagccatcatcctcagcaaactaacacaggaacagaaaaccaaacaccgcatgttctcactcgtaagcaggagttgaacattgagaacacatcacacagagaggggaacaacacactccagggcctgttgaggggtggggggtgaggggagggaatttagaggacaggtcaataggtgcagcaaaccaccatggcacatatatacctatgtgacaaacctgcacattctgtacatgtatcctgtttttgtttgtttgtttgtttgttttagaagaaataaagaaaaaaaagaatcacgtggggcttattagtatgtgagttcccagaccccacttgaccatactgagccagaatctgcaaggatttacagagccttgtggggcatggtaagactggtgttcctcccaaagacccagaacacaggtgcatgcctgtgattatcctaggtctcttgctagcactgtgtgttgaggtagtcagccagtgtcatctgatgtgatgacactttgtcatatctgagacctcccagtcaccctttctcacgcattactgaggtgcaaaccaagtgtcaaaaaacccaaagacacattaattaaattgaatcctccaaagaagtgtttttctcacatttttaagagcatgagatatttttatgtgagcacaatgtgaaacacataaaaagatttaacttgtaaataacttgtgtgtggtgtgtgtgtgtgtgtgtgtgtgtgtgtgtacgtttgagacagagttttgctcttgttgcccaggctggagtacagtggcacgatctcagctcactgcaacctctgcctcccgggttcaagcaattcttctgcctcaacctcccaactagctgggattacaggtgcctgccaccatgcctggcaaattattttttgtatttttagtagagatggggtttcaccatgttggccaggctggtctcaaaactcctgacctcagttgtcccaccaatcttaccctcgcaaagtgctgggattacaggcgtgagccaccacgcccggccataaataacttgtttagctcatatgtgattgtccaattttgggcatgtatacatagatacatatacatatataaatgtatataaataaatatgtgtatatgtgtacataaatgattatgggcatatgtatttgtgtgtttgaatatatgtgcttagggatagggacacacatgtacatgcatagatgacttgccttcgccaaaatttatacagatgtttctcaacttacaatggggctatatcctgataaacccattataagtcaaaaaattgtaattataaactggcttataaaaagaccacccaatattgcaagataaaaggcattaactgtaagattatgatgcaagaggaaaataatgaccagaaaataagttggagtggaaaacgtttctctaaaactttctacgctatcattgaaatagctattaaataatatattgaaataaagattgttgcttttctctttttattttcccaattttcactcttattaagtaaaattactcagcttttaaaatcacttgtatcatctcactgtgtatttacagattttttgcttctcagaaatttctgtatgtcccaaattccttttaaatatttaaatattatgcatgttttacctttgtaaactcctacctttgtaaaacatgcggaatattatttatctcatggatttcacccactgtcaaaagtctacttccctatcaccaataaatacttgaatactattaagtgataattttttagaatcacagggatcaaactatagttgacttttgaacaacacagggattaagggtgctatcaccacccccagtggaaaattcatgtgtaactttttgactccctgagaacttaaccattaataccctactgttgactggaagccttactgataacataaaccattgattaacacattattttatgttgtatgtattatatactgtattcttacaataaagtaagctatacaaaaaaattaagaaaatcataaggaaggaaagatatattgccatttattagctgtgtgggtgaagaaaagttacttaacttgactacgctcagtttattcattaaataatctttgcagacctggtaagcactggatgaaataatgtaataagacaaaaatgtgaagattttctccatagtcttatcactctgtatcataatttaatcatgtttctttacacggtttctcaattcctgagagaatgattttagacaaacccagagaactctctttgaatatcattctttgtttcaaatgtatttccttgtggcaggaaacgataaacacacatggcacagacagctagtgactgaaggggaagttaatggtgtttgtttttcctccagaattagtagttcagaaattaaaaataaaaatgtggcttgccaagtttgtaaactacacagaattctttgattacaagatgacaatgaatttaatttttttgacatttgtatttctttgatacttatgaattgaaatgttttgaaaacttatgaatttgcagctttacattttataaactataatgattaaaatatccaaatccattaatttcttccttgccctgtaaacttgaaaactgagaaaagatttagagtaaagcattttgaaatcattgacaagcacaaatactgttagattctatgtcaagattgtattgctgcccttgaggagacattatacgtgctttctaagctatgacgagaagacataaacaaggtctttccccagctatgtgctagaaaaaaacccttaattgtgattgtacagtattgcttgatgcaaaagtcaactcatttttcaccagggattcctgtccattcctggaaatgaggtaggatgaacccggccggggggcgggggggtgtcacagtagaaggtggtggtttaggaaaatctacaagtgacggtaaatactattctagaaagttaatttttttttatttcagggagcaaatcctttatatttggcaggtagaatgcaacttcttggtagtgtctttcatttaattaaaattaagattgatgtggcttgctgctgctgcgtaatatcattctgacttttgcatagctattgcatttgtaaatattcaaatgcactttgttatggataaaagggagttccttgggtagatgtttaacttttattgcaaaacctcttgtgctcacttacgttgccagatttggtagtagtcatgcaccctgggaaaatcactggcaaagcagtggagtggaaaggaatcatgggtatttactgtgaggagaagggaaggtaaaggtgttgtaggggttatatcatttcactcaggaatttgcttttggaaatgtcattaaggatatagtatttggggatggtaggtatttttagaatgtttctaagtaaaatcacgatttttcttttaatgcactgtgaagaaatcatctagtccagtgctcatgaaatcaatttagtaggttgcaattcaacaatggaatagaataggctaaaatacaacatgccagaatgcacacacgttgtaacatttagtgttaatttatgagactgcatgagttttatatagataagcatgtttctatatatatgtgcattgtatttaatatgtatttctcagtatgagtagctgttgaaaaagcttaaaagccactgattgactttttctcccattttacagatgaggaaactgaaagaggctgattctcattttatttgagtgggtctccttgaggcagcttatctgtcatcaggggtctcttgttataatctgtttaattacctatgcatcttttacaatttttcacccttgctcaaaaattgctatatttttgtgaccagaaattggatcaaagatgctgattctggggagataatctttgctgagtctctgagcaccatgttggatgggtagttggtgcttgtaataccaaggggaaaagaacagaatatttatagctctctgtagaggtaagatcttaggtaaagtcagatgaaaaggtggaacaataatctaatacatttcatcaatagatacaacaaatcaccattagcttctaccatttgtttcagttcagttcaacaaatatttattgagctcctacttagtatcaggtattttaaaagctagccacttacttccttctttatgataaattaattagtcaaacaattaaattattctctccctttgcttgtggtgtacagggagatttactgaagtaaaagggggtttcgtttgtcaaagatgaaagagatgtagcgccatgctatataacacaatatgctacttggaaatctgttatgccttatctagaaatgttcctaatatcttgaactccacctttcactcattaggaagtcctgcaatataaagctcacctataatattttctctatatttgctctcataacacattgatttatattgaactttctccttgttgctatttatacagtgtcagttctgctctatgagctgattttttttttctctgactacctgagaattgaggcagcagggccaagggggccgacttgccacgtgaggttttgtctttcccaccttgttaggctgcttctttgcctttctgcctggcaattcctgaaggtggtgttctgttttatctcttttttgtttttaaagtgtttgtgcaaagcatattattctgtttttactttgcttcttaattgagtatcggccatgtaacttattgtttgaagcagttacagcatcagggaatagtcccaaatggcacgatgagcctgatttttcctgatggctgtcactgtggaaagggacacccatgaggtcggtccaagccaaagaaaggagatgtataagtacagcctaatcttattagtgggtctagaaaaactgcttctttattaactgtcagtcttttaaatctttgctaattataacgattaaacatgatattttgtagtcatttctacttgcattcttgattattagtagttttgagcttttttacatatctctgtaggattttcttcccatgtttggaatttctgtttgtgtcctttggttatttttcttttagactattctgttttgttattgatttataagaccttttttctatcctattgaaattaatcattttcattgtggttaaattttatcattttaacatattttgagtgtgcactttagtggcattaagtacattcacaccatttgccaccctcaccgttgtcccatctccagaaatttcccgttatcccaaactgaaaaaaaccatggtaggtgctatgaaaataggcccaagggcctcttcgattcttaacaagagagatgctaaccccttttttcccacaacactagtaacacttcttgaatcatctaatcccctaattatttctctggatccagtgctgccatgatgattgcaacttcattttaaagatgtattcatacattaaataaacaggcaaacagctgttctcatatgaccatcttattgagcaaattctgttttgtttagtctttatagttcttccacttgttatttaatctactggtgtttgatgttttccttgcttgccaatgtggtatttccagctgtgcatggaaattaattttctatttgaatagacaattccaggaaattatctattaaggttataggaggcaaagagaatgttgctttatagttttgtgtgtgtgtgtgtgtgtgtgtggtgttcttggcattataaggaggaaaggttggtttaagagttcatgattgccagtttttgtttttaactaatattacttaaataaaacaaactctgccactggtcacaaacgctgtcaataataggaagtatggggaactgaaaacttattctctatctgaaacaacaattctaaatggattgctcatggactctgaaaccttttttggacaatagacctctttgtgtatctgacagattctgtggaacctcaaaacctaaggttcccatatttttatctaaaaccctagttgagatgcattttggagtcaagaatttatcagattttaaaaaggtagtatgatttaaaaaatgtattgggttttcaaaagtaccatatacccccatattacctatcacctttaatggggtctgggatggttccctataatcaaaaaatagtatttctgcagttaaattcatagatcttaatcttaaatgagataaataaaaacatgaaatagcctcacatctgtgtaggtcagtttatgctgccagataagttgaggtttgttgccaaacaatttctgaaaaatcttttgttctttaggatcagtgataagggacaaacacaatttcacctatactctagggggttccactgttcttggtcaggagtgttttggctccatgcttcagccgggcctgcttctcctcagccctactcaagtcatggacttagcattttcactgttacagacatttttgcttctggagttctgcacctgtcacttttttgatgaatttaatcctcttttttgcagccatatcgtatatgggctctcattctttatactcaatatgtttgccgttatgtataaatgtttcatcataacgtgaacacatatattatgttcatcatcatccctattcctttgtattggttaaaaaattggttattctcaatacttgaaatgccttttttctgtcttcctcctgttaatttatcctctaccccatcattgtaccaggataaccgattttctccttcttttatattctctatattcttttaaagctttgtgtctaccactgttttagcatgcattacattcctccataattatttgaatatttatccatctcttatataagactgcacatttcttgagagtaatacctctttatatatccattgccttgcacagtgcctggcacatacagattcaaagcttttcagcccaagataaatagaaggtgtacatttggagccagtggggtaagattggagacatgagaaagagggatgtacaatcttaataaattagagttcaagacagaatagtgtagaggaacagtgattttgtttagtttatgtgcacatgaggattaggaaattaaatgatatatatggtttggagaatggagaaatttcaaaaaggaggtaaagcttcagacaaacctgggcaaatggatgagattgggatggaataggcaaagaagaatgtacagtgctttcagagaagggagtatgttgaggagcgaattggcattggtggctgaacaagatatttaagctattgccaaactataatggaagttctgaattatgagatgatggaagaaaaaggtcagtaggccaaatggtgctggattatgtaaagcaatatataataagaaaaagaattcgatctattcagagtaaggtgtcattataagttaaggagtagaacagggatggtaagataaaaaacatttctgaaaataaatgtgtccacagcgtacgcagtgatgcctgaactaaaaagggtgtaggggtgtggggctgagttgttttacatcataaggacctgaaccgagaagacagtaatgagactggagaaaagggtgtgaaacttttgaaaagtaaaaccatagtgtgatagttaatttcttgtgtcaactggagtgggctacaggttgcccagatacttggtcaaacactacttagggtgatactgtgagggtgattttagatgaggctgacatttaaatcagtagactgagtagagcagattgccccctttaatggggatgggcctcatgcaattggttgaaggcctgagtagagcaaaaggctgaccccccttatgtaagagagaattctcttgcctgacagtctttaaactgggacattgaccattactggttctgcagtagccttctggcttctgactcaaaactgggaaatcagctctgcagcttttggacttgccagaccccttaatcatgtgagccaattccttataatcagtctccctttctttctctctttctctggagaaccctgactaatacgcgtagtatatggagactgactagatatgggagccacaggagttgagaaaggaattaacaattacttaggaatgggaatggagaaattgaaaagggcagtcaattttgatggaaaatatatttggttttgattttgttgactctgaagtgatattggagattcaagttaaattactgtaagcagctgtagtgaggtaggtagcttgtgtgggtgaggctggatgttgcatctttgaatcatctacaagtagggcaaaagaagttacgtgacagaacagagttcacaggtgaatgagagagacaagcataggcaaggatttgactgaggttcttcaggtgggaattatggggctagaggagaaagatgagccagtgtataaaaatattggtggcagagctctcttgacattggtttgtcagcctcttgcaccagaatgtaagctccatgaggccaacaatttactcagtcctttttccctagctttaagtgttgtacttcagatatttgagatttgtagacattgttttttcttcattttccacttgagacaaagccttttaaggaaaactgaaccaggaattaggatttatttgctgtaatcttgactttgcacttagatatagagactgaggtttgactttttaattcctaggattttgactcctttttcaaaaaatgaggagattggattaagaatttgtaggattccttacaactcaaaagttatggagaaaaatatctataggctgaaaattgttctaagctgcaaaaatggccttgagtaacttcagaaaataaacattaaagcaaatcatcttttatatcccttttttgaatgttttatttatttaatatcaatcaaaatactgtaatagattaaataaatcaaaacacatataatcttgtctagaagcagctttggactaaaaattttcttcgcaaaatattaaaggtgtgacttttaaagaaaatctcttaatacaggacctaaccccattttatatagcattaagttaatataactgtaaaaaagaaaaaaatataagcagcatttttcttttaatatcaacaccatagagaaattttggttcttatggaaattttattctattacaaatcttccaactgtaaaatcttctcttagagttgattatgtaattgaaaacaaagggaagaatcagtggctcaaatggtcctgtgtttaccatacttcattcaaaattctcttgcatctcctcatatgtttctagatatgttaacatcatacaatctcacaatatccatttttaatttatgcaagaatactttctgttttgaatagcacattattctaggttatatccaatgtcagttttgggtatttgatcaatatgtgatggttaaattatagatggctaactttttttcctaattgtacaatttgaaatatggtgaatttccaaaaaatagtttggagaaaatatgaactctattttaaaaatgtgcatgtatgttgatatcatgtatttgacatagaaactgtcaaacagaaatagatgtcataaactttaattcaaaggcattagactactagcactaacaaccaacattttttttttatcaaatagaacttattttgcccccaggatcatgcgttgttttagatattaattaacattataattgtcttctcactttctggtatgcaggggtactctccatgaccaatctttgtcatttatcacctatagtgtaaaatttccatcaggaaacaatcttctgccttgaactaccaaagtgctgattttgctttttgtcattaagttttttgtttgtttgtttgtttgttttaatttgctttagagcttctttattgaggacaactaacagttaagagttttcttggggaatagtgtcacagcaagaatcacacatagacttttcagatacaattcttctatctccaaagtaatgctagaaatattgttgatttacaatagatataatttaaaattatttatttttattttccacagatcccaatttctggatttcttgtgaagtttaataatttatccttggattcattttatttttgtttatatttatatagaaggcatttagccattcatgttgatcagctgacctcttagttccatttgtataatgtaatatctggttatataaacccaaggatctgctgttattgtttgctctgcaatctgatagataagagattaaaatagggtgggtgtagtggctcatgcctgtaatcctaatgctttggtaggccaaggcagaaggattgtttgaggccaggagtttgcgaccagcctgggcaacatagtgcgacctgtctttacaagacataaaaaaattagttgggcgtggtggcatgctgaagtcccaacactctgggaggctgaggcaggagggctgcttgaggtcatggtttcaagaccagcctggacaacatagtgaagtcatgtgtctaccaaaaaaaaaaaaaaaaaaaaaaaaaggctgtgcttagtgttgcacatctgtagtcctaccacgcaggaggctgagatgggagcgaggattgctggagcccaggaatttgaggctgcagtgagctatgatcacaccactgccctccagcttgggggacagagtaagaccttgtctctgaaacaaaaaacagagagagaaaaaaaataataagatgtatgtattcagaaacataaaaaagcaagagtaaaacttttgtgacaactttgttccatttataagtcacactaatgactgatttgcttcttagtaattttccatttgtaacattttgtacctggatacacaaatgtaatgcaattgaacaagaaaacaattatctgtctgctggaaataatgtacttatctcattgaaacaattgacttgtttaaaaatacacaggtctgttcagactgcagttacctgtaatttgtaatgaatttccaggaagaattaaaatcctctgatgtaattgaatcagtagttgaaaacactgattgtgaatgataaatttccatgcataattcccctcttatataaacctccatttggagccattttagatttgagaggttttttcaatattctatgagttttggctggatccctggaaaacttcactcaaaggctgtatcttccagtgaaagcttcatgttgacttgtgggttctgtgtcagtggaacgtttcagtactttttggcctggctcaaatgtttcttggcattttctgtggagtttggcccaaccaatctatagtatcacattggactccagataaaccctaaaagccgtaattcatccgcaagctaatatgggactttattggggtttggtagtagactaacaccatcgagcaattgggagttcaacattatgaatgatatttctaaggacatatctatctgaaaaatcatacaaagagaagctacttttcctttagcccagcacttatttttctcagaggtctctttcacagaggtcaatgtcctattttaattcgttattataattttttccctcctcagcagtttctaaacctattgcagatcaacagctttttcttctttcttaaagtgagatggctctggctcttggctgacttcagtcttgtgatgtgggactgatgtgcgttttcatttttcactttgaaggtgctgccaaagctagttaattttagttataccatcatagaatgctggagcctgtaggtgccctagaaatggtttggtacagcctcctcgttttacacataaggggagccaggcccagttccttagttctcacaggaagctacggcactgttaggatggaactcgtgtccgcctcgcaacagaacgggtctctgcaagtctatccggctgctgaaagatccactccccattcccagtctcagattttgtacctctgggtagttttcctcttttccttaaagctttttaaatgtagctccccatatgttatattaatttgggaaaccagccaacaaattagttttacatttgttaggattctagggtgttatttatgataccattctctttgtgttctgagtcactaagaaataaatataggaacaagacagagatcaaaataatagcttcattataaacagtgttaaattttagaacacatagtggacccaaggtggaagccagcttcttatgcctttaacagtcccctactgagcttagccactcagtcatagagaagtgtgcaactgcaggttcctggtccagccctcatctgcagggcccaccctcagggaggactagctgagcagcacctctgagagactccaggaaccaagggcctcctgccaagggaagggcctctttctcaagtctggccaagtagagcagtccatacccactcatggaaagcagtgtccttcaatggctcaccttctggtgagtgtttctctttccttcttttctcttgctttagcattcctgtttcacactggtattctgaaaccaatattagtatatttcttttccttgtaagatgagttattttcccattattctcctgaatagagttgaaaaagcaaaggtagcaaaatcagcctaggcaactgattatttacaatagagaaaaataaatgaagaattaagtagccggtaatgagagatggcaccatgggaacgtgctcagaatacttcccagtaatggaagatgaataatttttcctgttctctcctgaccaggccattgttctcacatttttaagaagagaaagttgggaaagacttttacctctctgtttacatctttgtttaagctctagacctctgccagcacccaccattgtattttgataaatatattctcagccatctataggtggattcacatgatcttgttttgctttcattttcctgtgattttgaattaagtaaaatttcagatcacagaactctcttggaaattttagttgattcatgtaggtaggtttctataggtttcactatttcattttgttccagatatttttccaatgtttatctctttttttaaatcttctacattagctttcaagatacttacttatgagagcccagataatatttaagttttcttcatattaagggatttttttttccttcagatttcttgccttgtggtgcatgttgcacagacacttgtacttaattcagaggtaaatgaaaagtaatttacaattctaatactcttgatactcatactttctcctttactgtttttatgcttgcaggtttcacttccttttagtaggttgagggccatttagataaaaaagatacagaattgcagactagtagatttaagagtttatgtattatgatttaagttgttaagatttaaggtgttccagtagcatacttggagttgaaatcatgattattaagatgaattctttttgcgtgagcagcttaacagacttctcttgaatcaccataatgtttttgcttcatgggcatgtcaagtatctgttatagtggaacctgagagaggtcatacaggaaatagcatagaagttgtcacagtacacctggaatgatgctcaagtggttgccatgggctcaggagccatttgcctgggttgaaactcagctcttcattcctttgtttcagtttgctcatctgcacaatgggcatactaattaagatatctacctcgaaagttcttgtgaggattaaatggatgaatatatgtaaagcagtttaaacgagtgtctgaacattatatatgctttataaatgtgagctgttaaaacagtccccacgtgcctaattgggtgaatagatcagggttcctctgtgttttcaagtgtttctctcagtacactattatttaggaaaaatagactaaaaagatattgtctgaggtgttactggctgatattttaaaaggtgaaccatgcattaaaagattgtgagtctaaattttgtgtaatttaatattaataaataacctgacttctttgatggtctacgtgaaatatgaggatttcaggcactttgtttccacagccaaaccgtgtatgttgtcttcattactggcaccgattttggcattttgatttttaaattattttgtgcagttttcacagttgctcccattagaggggaagtattgaggaagtagtcttccagttattgacagatcttaagaagcataaaatggtttggtattttggagaaatgtaggataatataagacccagaggcatactattccaagtagaaaatttcatcatataatgcatttatatgtatgtggtatatgtgggtaggcaaattccatcatgaaaggaataatgaaggaacagttttggggcaacctaaagttttactttagtttgtataataattaactcagctgcataaatgccaggaaaataattagaacaacagattatgttgaatgcctaaaaaaatgtgtttaacaacttttaattttctttcctcccacacaccacttcctagtttgtttctggcacaccagttgtgtctcaacacagcggctgatctggtagagttgtgtgaacacctgtgattgtggcagaacaaattttctccttctggttacatttatcgaaagtaaaagtagaaggagcactgtattttggaggtaatgtagagatataggggatagcctaccttttctccaaagctatgtatgagctttcaatgttttgaaagctcatgcatactgaagcgtgtgtccacatggtgaatgtaaacaaacaaaagctgattgtaaccatcttgcttttcctagttagatatcaatgggctactattggtcagagaaacaaagagggacctccattagtggggaaaggtaaaaaaaatttagtgacagtgaaagttttaaaaataatatatattttttctgtttaagatattccattatatttatgacgttatgagattccttcaggagtggttgtttgataatctgtagtttacttaatcattcctatggtgttacagacagatttataaagttttgctattacaaattatggcaccacaaatacctatttgaatctgccttttttttttttttttttggaattatttactcagtttaaaatttctggcctgatgttattaggttaaaggctttgcatatctttgtaagtcaaaggatgtagattttaacaaatggcttttcaagtgctttgccaaattgctttctaatataaatatataaattgttaacaataatgtatgggtttttcagtttcactttttgagaccctgaacagtgatcgttgttgcttttttaaaataattttttgtatttattcaataaatataaagtggaacttcagtgttgtttcagtttgcattgctttggtaaataaaatgcgtgtgtgttctttttttcttcatgtgtctttaataatttaatttcctgttgtgcatgttcatgtttttgaggtatttttcttcttgattttctgtttttctgtcagattgtttatcccctgtatgtaacatacaaatcaacattttatcttatgtttgataaacatatttctgcaatatgttgtttttttattttaccatgactattacttttcttagtgttaaagctcaaactgttgtaaaagttatattattttgtttcttttattgactctaggtttaaaaagttgtcatctttcaaaaaaatattcaattctattttatgctaatgtttagtgaactaatttatatgtgtgtgtgtgtgtttataaacccacggatacatatatgcacaaatacacatagggagttagagacattagtattataatgatagtatatggcatacattttgatccatttttttcctcaaattactagccagttatgtcagcctcattgattacatagctttctgtcttctcctccccagttgttttaaatttcccctttatcatattattacattctaacatataattagatattttactgggctttatttttttattcactgatctatttcaaattagatataaaaatatttttaaaatttaattcttcaaattattaatgcttgataatatgctttaaatgtagtaggttcaggtcttcttttccaaaaacattgagcttctcctgtgttacaaactgtgaatatggaaattaaaattatacggtttccccactcatagtaatcaaagtcttgctggaaaaacagacatgtaaaaatgtaattatactataatgctacaaatccagaatggagagatgaacaaagcactgatagcaccgaggtgacagtatatttttacctttttcccctatattttctagttctaatgaaagtttgattatgatctaaattgctaatttattatatctacaaaataacttagaaaaatttgattttttaaaatcctataatcttctccctcagggttattgtctgtttcatctttttaattttctaattaaattctgtagttttccttaatgttaaatactggttagaaacatttcatgttaaacatacgcatcttatggatattatttgtgacagtctacaggtaattcagtgtttgatttatttctttaaagaagcctatattttgggtttaccattcacagggaaaatcggagcccatacttttttatctttctttattgagtgtggggtctcaaacattcattggtaatacctttgggatttggtaagaaatactgcacacagatacaatgtagaaatttcattgagatttttttaatagtaacttttaatagttaaaattttgaatagttgcttttgaaatgaatgataggccaatgaaaaatttgtgtgccatgaaagctatatttttatgaaaacctgattggaattatggaaaacaatctgtgttttatagtcatggaaacctgtgactgatgatcatttttggaatgttaattgtaatttctatcattgcagctgttaattggtaacaaggaggggattaaaggcattaaggagttttggaaaataaaacttaaacacacatcaaatagcaatcatttctggaattctgctcatattagttgtataaacctgactattaaaatatagaataaagtttatttcattattccagtttctaaactgtatattatttaaaaatatgtttgtatttacaaattaggtcaggagtaagcagggcctcagtgacgtaaataaatcccaatggaggcttgtctttggactttctcttttgtgtaattctttgtatatacaagatccttggccaagatcccattatacaaaagaaaaggtggggatgtgggggagggtgaatattcccagagaaattcagcctttcaattacttgattattcttgtggttgcaggaaattaaagaataataagtttgtttcctatgtgaatcataaaaaaataataagggtacacacagggccattgacttaaataaatggatggaccttaaaaaattcactttttggaggggtgcatcatgctttttgaggacacactgaaattttgttggtaatcccagttccaagcctttcaagttagtttaagtgtaggaagaggagtggcagcaactggataataaatttagtacaaatgtttattttatttcatttatgtattgcctcattcaaaaaatgattcgagatatcttttcttttttttttttttttgtcttttgaggcaggttctcacttggttgcccaggctggagtgcaatggtgccatattggctcacagcaacccctgcctcctaggttcaagtgattctccagccccagcctcccaagtagcttgggaattgtttttgtttgtttgtttggtttgtttttgtttttgtttttgtttgagatgagtttttgccatgttgcccagggtggtctcgaactcctgaactcaaagcaatctgcctgccttggcctcccagtgtgctgggattacaggcatgagccactgcaactggccctgatttgaaatatcttataagaacatgttcaacttaataataataaaatgtgtatagaagaaaaggtgcattatctggaaaagtataaataagaagaaagtcctaactggaaacaagaaaataaatattttaggatccatgcaattttgttttgattcattatttttatttatttatttttaataaagataggttctcactctatcatccaggatggagtgtagtggtgcaatcgtagctcacagcagccttgaactcctgggctcaagctgtcctctcacctcatctgcccaaggagtcttttttttttttttttttgatttgagctttctagcagccaaaacaaaaagagtgctgtggcataaaaggatagatatagatgccatgtcttttgccacacacgtgtgcatgcatacacacacacacacttacatactgtctctcataattatttatttattattagatttatttatttattcatttatttttgagaaggagttttgctcttgttgcccaggctggagtgcaatggcgcgatctcggctcaccacaacctccgcctcccgggttcaagcaattctcctgtctcagccttctgagtagctggggttacaggcatgagccaccacgcccggctaattttgtatttttggtagagatggggtttctccatgttggtcaggctggtcttgaactcccgatctcaggtgatctgcctgcctcggcctccgaaagtgctgggattacaggtgtgagccactgtgctcggcctatttatgttatttttaaaaagcaaattgctttcatgttccttaggagtggcacagctatgtggatctctaatttctaaaataaatttctcatacgtatgcttagtagtactttcgtttcaaagaactagcttacctgtgggtgatttcagaccaacctgttcagttcttctgtttgagagacaaattcaaatgcttatagttacccagatgaccacctttcacattttctatctcatcctagctaccacttctcccttaacatcacctgcaacaaacaaaatgactcccctaatctgaagccaattttaatttatgggatggacctagtcatttgtatccaaaatgtctgagagtatcttttttttttttttttttgagacagggtctctctttgtcatccaggctggagtacagtggcatgaacaaggctcaggcagcctccaactaactcctgggctcaagtgattctactacctcaggctccttagtagctaggactacaggttcgcaccaccacacctgactaatttttatattttttgtagagactggctttcgccatgttggccaggctggtctccaactcttggactcaagcaatccacctgcctctgcctccaaaagtgttgtgattacaggcctgagccactgcacccggcctgtaatatattttaaattgtaaacaaagttatcattgataagatatagaaaaaaatttaaaaaaaaattttatctagctgtcaatgagaaggaaagcaagctaaataatgaaaattaaattagcatgaggaaaatgaaaaataaagagagactggaagataccacataattatgtggctcataagtctaagagttttgaaataataattgagtcaggaaaagacttctgccttactcatatgtgcattttttgcatttaatattttattatatacaacttaattgtcccttagttaagtcctaatccactgaataaacaaaagtaattagtcaacataccttgcttagcagctttacctttttcaaattttattttgtttatttattatgtcatttccaaattcctgtgggccttttggtctgtaatctccataaaccactgtaggcatagacattttaatggaaagggctagtgacttttctggttttgtgaccttttacattctgattcaacaaaactttattggtcacccgcttatataacagtcactatgccaagagatttttcataccttatcacatattactttccataataaacccatgaggtaaatactttatggtccccatttaatataggacactgctaataagcctcagggagaaatgagcccagatcacattgctagtaagtgctaaattttggctcaaacccatcttgacgcttgaagccagtgttctttctatagccatatctcttgctaagtacttctgacttttacttaagatatagtcttctctttgattattaattactctggtgtgaactgtgatcttttatgaaatctaagactgctactattatccgggcaaaattgtggaattgaatcattgagatgctgattgaattgttgttgatggttcaacaattttgagatgagacagatcaaattttcctttattgaaatcagagtggttggagcttaataaaaaagcagaacatcttaaggtaaaagagcaggtacttttttctttttttttttgagacagagtctcactctgttgcccaggctggagtgcagtggtgtgatcttggctcactgtaagctccgcctcccagtttcacgccattctcctccctcagccttcagagtagctgggactacgggcgcccgccaccacgcctggctaattttttgtatttttagtagagatggggtttcaccatgttagccaggatggtctcgatctcctgacctcgtgatccgccctccttggcttcccaaagtgttgggattacaggcgtgagccaccgcgcccggccaagagaaggtacttttttttttttttaacactgacattagttctctttttgactgctaaggataactacaaatgatacattctgtaaaccttttgtctgaaataataaagaaagtgaagcacagtaggaattctttaaaatgttgtcttgttcattgggcatttattgggtacctagtataatccagatattctgtggtgttctgtgatacaaccttaaataagacaagacatagatctggctctcaaaatatttatagtctaagggggaaactttgaatttataattagattgttaattttcaaaaattaaaattcaataagttgcttattagcgtcatcggctttggaaatttaacacttttctaatgaagaacataagttccagttaagagggtttcctatttcagacaatgtagaataaatcagcttgttccataacttttaatatttttcaaatataactcgcattttacctttagaactaaagatatgtcgagaagagttcattataatgtaattgagtcacttaccaagcctattttaaaaccagttacttccttttcttactttgcactctgtgacacatagacttccagaatcagagaagtattgtttttgtttttaggcacttgctatattatgtggaaccaaagccaagttaatatggctaagtaattttcagttcaaggtaggatattagatagaaattctcttttctacttctagatttggacatgaagtagcttttcatgttataaaatgacaaattttatttatttgtaatgaaataatcccttttatttatagccaagttcatcattttaacacttaatcttccatgacagtccggaggagaagaaacttggcaaccattcattattatctgtttttatcatcagaaggtatttatttgtagggggagtgtagaaatgatgtcaagggtaggacatttttgtacaggacggcctttcctttggagtcatgatggtaaatatgaccacagttacttaaaatgcatgcaaatagttaccagtcaagatgtataaagttccctggaaactcagaagcatgtgattatagctgtggaatgagaatgcctaataataaaaggagaaaatgtcagttttggattagtgatttaggaatcccatcagtgactatctaatcagcagcatttcacccgttgttttacaaagctcttattgagctgtgcttccatacctttgggcttgtatgaagatctgctcatcatagaagcccacttacctatagtttcaacatgacaaatctgagcttaaacacaaattagaatatttaggccctgaggctatttcttggatttaaatatagcacatagtaggtgaactttgagcttgataatgctgtggtacagtgagagaaggccagtgtcaaggatatctgaattgatttgaccttttgtccttgcatgtgaaaatgacgtgcttctgtagaagtctatatactcatgacttccttctaaaatgattattgtacagtattctatggacatttgatttgattcttctcacaaaattatcgagacatccactagtgtctacttaattgatggcaaacaagaagaaaactgtaatctggagataactaggtaaaccacatattctacatctgtgcctggatagaatgacttttgtggttatgtatgcagcaaacacttttgagtgctggtcatttccctaagctctgagaatgcaaaagtgtgccgtgtccattgtgattattgtggtgaatacagagtgttgtgagagtaaataatgtggagggagtgagaaaagcctcctgtgaggacatttagctgagaaggaagggtaaggaggagacttaagagggcgtcagaagttctggagggaaggggagagtgggagtttgagggacaaatggccgtcatggtggagtgaacgaaggggaaagtcacctgggattaaggataaagagaattcttgagtaactaaaaaattgatttgttcacgttgctcagtgattctctgactgtgtttctttggggagaggcttataaaaattagaatgtccaagtcttcatagctatctaaatgttttctgcatgtttctgtccagcacctatgtctgacttcatcccaatttgatgattaggatgatgataaacaggatgatgaataatacaactatggagatttaaattagaagaaaaaatcttctttatctttttttattgtaagatttattaatacaaatctgtattgttattcagttctagaatgttctaatatgcttcttccatccaaagttatgattacttctttacctcatataatattattacattttcttacaataaaatacatttttaaaattcactattaaccctgtctgtgatgagacagcataatcttgtggttaatattagctcaggctctgtagccagaaaatacgggtgtgaattcttgttgcgtcatcaaagatacagatgtgagtcctggctgtatcattcactgactgtttacatttaatatgttatttagccttcaaaacctttgtttactcatctgtaaaatgggataataattgtaccagcctcctaggataggtaagatgttgcagtgaagtttcttgttacgatgtatttccttgattatttcataagacagaggaggcatcttttctgtgttcctcccttgagatactaaaatggccagggagcaggtaagttccaaagattaggtttcagactgtcatatacaacttgtagtccatctgtgcagctggagactaaaccaaagtgtcacataaaccttttcctaatcaaagtggttgttcatttattaatgtaaatgccctgtgccttggatgtgtgagtcctaaaaatacacttccagggataaaaatagatttctgggagttctgagatgctgcttaatcagaaccagctgcaagctgtctagaaaacgcaagttatatgagccagatggcttttgccctttttgctttagacagcatgtaatttggataactacagctacagtaatacattttgccagtcacagtgtttgataaacatgtttgttgagaacagccacttccaattagagacccagtaaaatgttaatttattttaataaattttccctctagggcaagacaaagaatacttttgacaggttacagaaatatctgttcatggaacagagtactgttcaaaagttattgtatgccagtgattaatttttcaatttggcatttagagaatgatgagcagtattcatgacctccccctccatttttctccttacaacctcatgtatatataagagaccaggatttttcatatttgaaattatgttgctttacgtgtagaaagatggtttagctaatttttaactttcttctacccatgtctaattactataaactctgataatagttactgaattattgcttgcttacagatgcttattaatgtggtagttcttgggatttttcttttatgatcgtattctttgagaagaaattttctctgttagtcttatgtagccatgactgattttcatcagctgaggactgcaaacgtagtcactgatattggctgaattctaattttattcagctcctattcagacaaaatagtaaagctaaatgtgtaagctattcacactgtaagacctaaactcagatacagcctacttttaggagatgtgaaactatcaattcttccattttcactggtggcaccacttcttggaaaagcgtatttaagccctggtttcccattacaggaattgaaatattctgtgctttatttcttgagacatgtctaccaggcatcatgtaacagactgtgaagtacctttgaaggatctcttgagtcataatttttccataattccagtccttccagctttgtaagtttagtaatcacccagcagttgtttttttccttccccagtttaagaggagagggtatttcatttccaggataagtgatattagaacataaacatcattataatagtagctacaggtttatttactcttaccaggaactatgctaatcactttatacattattgcatttaagcctcactacaacatagtattataaggtatatatttttattctgttttgcagataaggatgtcactattaatataacatttttatattaatagagtataattgttctagaattatcactagaatgatgattattcaacatcatacagaaagtattacagccagaatttgaagctactcttgtattaatggtgtgtctggctcaggatctttaattccacccattaagctatgaaaattggcatttgacctaactagggctgctttttcagaggtaaatgcatgcctctggccatcttcatatacttcaaggaatttacagtattgcttcttagcatttattttaagctcagattgtatgtgaaagagtctgatctctctcatcccaccttgttagatgaattataactgatgtgctttaaaaataattcatactgctggggaaaaaatctcactttgatgcttttccagtatatagttaagaattacactgatgggtagtaattgaagaaattggtaagcacttgtgtgatatgaaacagcataggaaacttatatataatatatgatagccattatatataagcttatatataatgtgtataacatttacaaaagcaaaataatacctttatgtttttatttaacaaagtgagataaattcattagtgaatgcagcagggcatacctgcaaattctgtcataggtagcaggaaataaagcaaagcattgtttataaaaagacctctttgttatggttctgtccactcaaagcaaactgatgggggcatggaaaagatcttattacttttgactattttggaagagcatactgttggtattattttcatttgcagctataaaatggtacttcttgaaagataccataaaataatagaacagtttatacttaagtactatggtatgataatgggcttatgctgtttgttagcaaagagttggtgttatttgttgtttcttggaaatgaaagggagaaacagataatattcctttctaataaatggattattctattctaccctattctattagacaattttatatccaaacaattactgaactctatttttcatatttcacagagttgtacgcaagatctagatttgaatatgaaatctgatacctccgtgggccagtcgaaaaaagcattttgatatcattagatgagagacattatagacatattagttctagagaaagtcccggtcctttctttatgtcaagagatttgtgttagaaagagccaacaaggcctatgcactcaattaatatacatcagttttctgttagcatgtaaggtcctatagttggtgttcaagaaaagaacatgatacatgaaaagtgatctttgccaaatgtatccatgtttatgctaatgtgggtaaattgttcctcttttaccatgtgaaggattggtagcttaatagtttgctttgcttaaatgattttatgtggcagtgttgaggatctgcagaagtgactgtgtccttgccctcaaagaacttttggcatttggcaccaaaagggggcactgctctcttgtgacataaaatgtagtccccgaatagtggggcttttgaaggttagtgactccaaaggaaatagtagatgaaaggaaaacgtatttacttcatctcatgggggtctttcttgccttggtcttcctgaagaaaagataagcattgggctgaaaatgtttgttatatacccttgggcaccattggcatattccaagctgtttttgtcaatcatataaatacatatttagacaatttctgaaacatttctcataaagaaagaagtcattcatctggtatatcatattcatatgcatgatggctttctagagttgtgtcatttcttcactatggcttctctcgtctcgcacctcttcagaaggcacccttcctttcttttttcagtaaataccacaattttatttttaggtgtatgcagcatgaaatgtatgtgtgtatgtgtgtgcctgcgtgtctgtgtgtgtgtgtgtgtgtgtgtgagagagagagagagagagacagagagagtttgagagatagaacagagagattgattaattggttgattgattagttggttagttggagcttttcccagaaagttttccaactgttcttattggcatatttgaaagtttaacaaaatctcattaaagttcatggatttcactgaaatctcttatttttattagataatcagtaatattataagtatacataatctgccatcccaatattttcaaattttagttctttttctatcgtattggtaagaatgttacagtttcttcctaatgttggtgataggcatctgtacatctggttttgttggaaacaactctgctaaatgtttaataaggtgctcattgtaagttaaagatagggaatctttattatattatagaactaccctggcctatgcacatgtattgagatgactgcatgttatttagcatgcagggataggttctgttttaacatattttgacctattgatgtcgtaacttcattagtagattacctagtattaaaccattctgggatttctgatgtaaacacaattggacatgttttattattatttaatatgctgttgggtttggaatgtatttcatctagcatttttgcctctatatttgtgatactgaatgatagttttctgttttgtcagctggttttcaggttttagtgtcagggttactaggcccatcacttatgattatacaagttgtacactgccacctataatattgtcatttgcatagttattatgacagttttacaaaggaggacagtaaagtatcttgaggaagggacttttttttaaaaccgtattgacttaccatatcaactagcagaatgtaacattctaaaacagatttttaaaaaattccatatttttccattccttcaatgtttaaaagaatccacgcaaaaaatcagtcaggtttatttgacaatagttgtttacttaaatttcttctagaactgttcatctctttagggtttatatattctactcagctgggatgatcttttaattttattgaactattaaaattcattctttaacaaccaactatacataatattctttataattcttttattcttttctgtgtttttcatcccccttttgttactttactattttatctttttcttgaatattaagatttgccttttgttttcctcttttttccttctccaaatacttttggctttatttactggaatgtaatattttagtatttgaaattaacaactgtttttatctttattattttttcctcttgctttccttagatatagtttgttcacttttttaaaaggtatttgcattgaatatttagctttcttattttctcttattttttattttcaaaggacctttttgggtacttttaaagtttgctaatttactgtaactggaacatttaatatggagttgaaccaactaacataggtgtgctatccatgtgagaatccttcggaaacatttagcttgacaaattgaaacactggaattaatcttaaaaatctgtattaggattgcattgacaatgtctagtgttttaaaatggcagtttattctctgattttaaaagcagtacaagttatccgtggatatttggaaaatatagagaaacatgcttagctatgtaacaattaccctaaaatttaacaacttaaaatgacaaacattaattttctcacacagtttctgagggtcagaaatctgggagaggtttaactgggccatttttgctgtgtctctcctaaagtagtagtcaggctgtgggctggagctgctgttatctgaaggcttgaatggggctggaggacccatttcaaaaatgattcactcacatggctattgactggaggccttagttcctcactggctattggcaaaagatgttggtttttttgccatgtgggccacttcttgctgcagagtgagtgatccaagacagagtaaagtggaagctacaatgtcttttatgaactactttcagaagttacatactggctgggtgcagtgacttgtgcctataattctagcagtttgggaggctgaggtgggcggatcacttgaggccaggagtttgaggccagcctggccaacttggtaaaactccgtctctactaaaaatacaaaaattagccaggcatggtggtacacgcctgtaatcccagttactcagaaggctgaggcataagaaccacttgaacctgggagatggagattgtagtgagctgagatcacatcactgcactccagcctgggagacagggagagactctgtctcaaaataaataaataaataaataaatttaaaaagaagtgacatactgttccttctactgtattccattgaccctactaaccaaccgttatacagtgtgggggataatgacacaagggagtaaatgccagaaggtgcggatcattgggccatcttgaaagctatccaccacacacagaaggacatagaagttacgcttaggtccaccattcagtccctgtggatcttccaggtttttgttttcccttccattgcagcagaccataaacatttcttatattatgaaatagtgttctaaaatgagatttttatatgtttgcttagtatccatttttagggcatgccaatttattttaccagtttcttaacattattttataattgggttgttttgagcatttgactattataaattataatatttcttgtctacaaatccttgagcacatctcctgccatttacctaaaatagattcctagaaatgttactcctgggtcaaggcatgtaaacattttaaggctttttacacataatgtcaaaatattctgcagaaatttgtacccaaatttatactagtattgccataacaaaatgatgcctaacttcttatgtgcttttcaatactaggtacaatattttaaaaatataaagagcctgataaggaatatagtatctcatggcagtttgaattttttattactaataaggtaggggaattattttaagagtcttattcttgaatctatgtagtatttttcttcttgatttttaaaggtatctttatcataattacttttaaagttgtaattagttctctttaaaaaaattatagtttgctttctttcaaaatttatttcactggatgttttcattaaggctatacaatgggagtggttctgtaatgaacctggaagtgttgaaaaataattgaataacttaagcactttcaaaataccaattagtttgttggtgactaaactaagtttctctaacttacattttattgattgaacatttgctagaataatgagttaaaaagtgagaagatgcttttttttttacttttgttgtaagccatctgccaaaatttggtgagtgctgaggaacatttgtcaaggaataaaatcataattgagagttgtctagtctgaaaaaataataaaaacactctcagtgtttccatgtgatagaatgagaatgactgttattacttcgaaagtttcctgcccaggactttcatataactgatgttctctgtgttgtacaaaaaagaaaataaataatagcttgctgaacagttttctggatttccaaaaaactttattttggtttttgatattttcataataattggttttaaatttgaaagttgttaagtaagtttaacagtgagagtggatagaatatgttgtctggcaaggcaggagcagagtgtagcagggagaccttggaataaggcgcttattttatagtcaactctgtttcctgccttgtggctttggtcctttcagcctgttttctcacctatacaaaaggaatacattttgccagatttgccagattattttcaaaactaagttatataatgtacacatagtgcctggcacacacaagtgcatgatacatgtataaagcaacaggaataactatggaaatgtgtactattcttaacataagtagttggaaggggagatcttcacaagaccataacaaaatgaaaaattcagtgatttgtaggtgaacattaaatttatgctataattctgaccaagagtgtatgtgatgggagggaggggaacaaatatttattttttgcaccagtgaagagttttgcaattatcgcattgctataaaagtttgctgaaagattaaaaatagaataatattagccatgactattcagaactgaagaccgtgccaaacaaagcaagcaatagactagcagtatgaactttgaaacccatagatgtgatgaattctgtggaaccagctcttaagtgtatagatacatagatgttcatgatttcactgggggaggctgatgatcataggtcttgaactggaattgaagaatgggttggtttgtacaagagtaagagagaaggagtgtcataagcccaggaatagtatggacacctacacagagacagataaccatgtagtgttttgctgtgaataaattgacctaacctagagaatctgtgtttgggatgcagtatggataggaatggtctgatcagaatactgagaaccttaattgtcaggcaaaagagatgaagcaaactgtagaccatcagttgaaaggttttagagactttaatgtagcagtgatgcagggtctctgtcgtagctcagatgtgggatgcactcttaaagtgagctcagtaagtcaggaagaaagcaatcagattccaaacactggaaccataatttctcacttatttcctactcaagaagcttttagtaatgttatcttgttctcttatgaatatgttgttttaaaaagaagaaattaaaatgtgacatagctgttgctttcctttggttgacctcacttttactttttattttaacactttatttttcaagaaaacacatactttgaaaaatcgtataattataattccacagtgacaatttctataatattttgcatttctattcctttttttttttttgtgacggagtttcactctttttgcccaggctggagtacagtggtgcaatctgggcttactgcaacctcctccgcctcccaggttcaagcgattctcctgcctcaacctccagagtagccgagattacaggggcccgccgccatgcctggctaattgtgtatttttagtagagatggggttttaccatgttgtccaggctggtctcgaactcctgacctcaggtgatccgcccacctcagcctcgcaaagtgctgggattacaggcacgagcccaattgtattcctttcttggaggtgtttcctatgacttatcctggctacagacctgctggaaagggagtagcatttatgaaactcctacattgtattatgcatgttagtctcagcatcccatttagtctttacagtatccttataaagcagatgatgttattcctattttacagatgtgtacactgagcttccagaaaattagatgactggtaagtgttagttcagaatgctctgctttgtaacatgatgcttcctgagagaatctggggaatgcacaacttttggcaggagaaataaggactaaactaagaacagcaatgttaattttttttttatgccttagagatagggaagttagtctccctcagaggaatccaacttgattttttctgagggatataatatctagtcacagggctgttcctttgcttcctgaggaagtgaaattcactaaattgggtagtgaccttccatatttaaagatacagttacagcttgctttagtaaaaatgttaacaaccttggaaaatgcaaaatatctgatctcaagaagattctgatacccttcattaatgaaaaaagaatgtcttgtttcctttctactataatgatcatgaattttccatgtcactctagttcctgaaagaagtgaattagtttgctagtagtgggtcaaaggtaactttctccttttaaaaactatgatgaaaggtgcgaggtttagatagtatggggaacttctgagtttctaaattataaaacacattttgaaatttgaattatgtgctgcttaatctggttcataattcttggtttcaaatactaatggaaatgttacttgcaagttaaaccctgaactgagaaacatgcttttctttattcttttataagtggctcttttaattgtagttcttttaaaaaggaagttaacacttaagtatctattaattcttgacaaggaccttattaaacctaagcaacgtgttttcaaaagggcaggtagctgttagctttatgtgagaaactaaaactaggaaagtaattattatgagcttcttaatcttttattttttccaaaatagaaatgtccctattttttcttattataaaaggaattgttaaatgtttaaaagtattgaaacagtactggacagtatacattaaaaagtgaatgtttcccataatcttaccccctacagatgaccactgattacagtttaacacatgtttttccagaacttgttatttgcaaatgtaaacctctattgctgtctacatatttaaaacattttaaatgggattgattgtactacatgtactattctttattttgctttttcttattgaaaattgttgttgatctatttccccttcagtaatgacagttctgtttcttagattgttggtttgttttgctattttaataacagtatgaagaaatacctcttttgtatgtttttgcacacttctctatttccctaggctaagttcttacaaatagaactgttaagggaaaggtaatgcatattttaaacttcaatatatgttcataaactgctctctaaaaggttttgccaatttactctcttgtcagtattgcaggagaaagtcctttttgactaactcttttacaataatatgaataacagtttttgccagtcaggtgagaaaaaagaaatgtatttctttgattattagtgtagttgagaagaatgtcatatgtttgtgggcctttatgtttctctcgggaacagattgttcatgacatgtaccttgtttttcttaagggtgtttgttttttctagtaatttaaagagcttttaatatagcctttgatacgtatgttgtaaatatttacatacgtctttttcttttacctcttatgatgatatttgttgcacaaaatacctaaaagttgacatatttacacacatcccattcttttttgcttatggtttctggcttttgtttgcatgctaagagtaaaaaccccggtcaattttttttttttttttggatgccaaggcactttatgtgcatgttcttattgaaacctcccagcaacccaatgaacagaatactttagcttcccttttatagatggtgggtaatcacttatccaaggctacaccgttttaaatgatagtgccataacacaaatacaggcagtcagatatctccctaggcccaagattattaatacaaacaaacaagaaaatctcctgtattgtagccactgtgttttctttttttaattgttaaatatttaattcctgtggggttcacctgtttaatttcattttcattttatactgtttatttatatatgcacatgtgtctacatgtttcctatatactcttattataataatcatcatttctttgtcagtaaaacattctttattctgattttagagtaatttttatatctaagggaaagtctccctctttattttgtctttaaaacttctctcgactattcacacatatcttttcttccagaatcaacatgtaaaatttaatgtacaaattctccttttaaaatagtctgtaattgcactaattgtaattgcacaattatcgtcattacaatatttatctttctattcaggaaaatagtatgtcttttaattaacttttttagtaaagctgaatagttaacttcatttagatttggggcatgctattgtaggtatattcctgggttaaattttgattgtgctcattattgttcacatgtacgtatgactgcataccattttgacagtgggtacatgttaaatcattactgtttatgaagtcagtgtccatttttatgaatattatgctagttcatgtcctctttttagacattcagtgttagagagtgaggaataattttaatgtcttgatggccaagactctacttaaccagctgttggtgactgaaagtccagtttcctttagatatgactcatagttcttggttggttcaaattctggatatcaatttaaaattgtatttaaaaccatagtggtccttaggggcccagaattcttcaaaattgaactgaaagtcacatagcaacatggaaataggcaggaagtcacatttaaattcttagcacaaattaacctccgcaaacaggtttgttccctgccctgccacccagcgtgggtgcttgtgtcacagtaggttctgggaagggttcagtattctcttgagattgggaggcacagaaacatcacacacattcacatggaggctctttcctaatccctccattactgctccctgtctcccataaccaagagaaaggaggcctttctttacaaagcgtgaccaaagattgtagaattcgaagttgaatggagagtgtataagaaattgaattcctaaaagaaatatgaggatgtaaagtaattacaataatcaaagaaggtcagagggaggagaaaggataataaagaggaggtaaataagaacatgaagaacattgaaccttccctttgtccccccaaaaaaagctgcagaggaagttggaggatatagaggatggatgaaaggggcaagacagtagaaaaatgcagcaaagtaaagatgatggaagtttagtaaaatggactgatacttacaggcatagttggcttaaaaaaaaaccctcactgatcctttcctttaaactgctcagtagctaaataaagaacttgttgatttctctctctttagcaggctctttcagtagtacattttgaagatttcttcatagaacattaggatattttactacctgactgaaagtggataaacagaactggaagatttctgctttgcacatttctgaagctttattttatccttatataggtaaagagagaagttatacactgagtatgccaaaatgaccacatgcttcacacttgcactacctctttttatgaatctaaatttggagttttcaaaacctcctgtttaaaaatacatcccaaaagacttctgcttattgcacattttgttcctgtcctgtacaactgagattttcatttataattctttttggaatgtttttctttttgtcataaatacaaaaggaagctattgacatataatccttcattatgttttatgcagtagcatcataattctcaaattttgagaatatatattttttctttcaagtctagagacaaatcttacaagaaagtttaattatgtgttcatgcatatacatggaatcttaaatataattgaatgaataaaaattaagttgccacaaattagtttatgcaggcatctttcacttaaaagatagtttggaggagaaaaaattcactgacaggtttttctattatatgatttatattttcctgttggatttcatgataaagttacagtttcattttatcaaagggaaaacttgttccttgatttttaaataggaagtcatattcagagatacattagtccttttaaaataacatatttaaacataaaatagtaatcttataaaatttattaagtcatacttagagtattaactgttttctgttatgctcaataaaaattataaattaaaaatgagggtaccagaaactcttaaaatataataatctatctctcctaattttactcataatataattcattaacccattattccatcttccaaaatgctaacttgcctctttccagctatcttgaaatgtacttaactgtaacatatctatactttaatgtatgtcactgaataagataaatttagagtatgtgaagtttaaggctgaatgttttgtggaattgttctttaaactaacccaaaataccacctttagactgctatagctgatactggagcatgtttcttgtctcaaggagcaaataatctttctaatattaaaccccagaatcagagagatgtacccatccagttttgggagtggtggacaactgcaggctcccctgcagggaaaagacttggcccctgtgagacatacagcacctggaggttgagcacatgctccctgtaggtgagctaactcccaggaaaaaaaaaagggatagaagaggcagactatacattgccctttttaaatctaccaggtcagtcactcctcctggaagaataagtgtcacgctagtagtgctccttccataaaaaaaactaaaggagtggggaagaatcattccctcccatagcaataatgatgtgtgtaagacagagttgatgaaaaaggaagtatggaatatggtgggaacatagcctagcctaggggttcattggaagtgatatttcagctgaaggaatagggagtaggattgaggaaggtgggtttgggcaagaagaaagatgtcttaacacatctgtggaatttacagcaattcagcatggccggttacagcctaggctaagagacagaatctggagtgatatagcaggatatgtaggcagtgaccagatctcagagtgagttgtgagtcaaattcagatgaataaagggcaacagaaacatttgaagggtttcaaatagagcgatgacagaatcagatttatgttttgaggggacaatcattctaactgtaatttggagggaagcaaagctagagagaggaagatctattagtggtatgcaaggaaaggaggtttgtgggaggggacgtgtagattagtatagttttataaattttgcccttgaagagcaagacattcaaataaagttgttaagaaagttagatgggtgcatacacataagtctttctgtgaatgccttttatttgaaatactgatcaatgggtttatgttaaagctagggtagccataaatttaattagccttctcccattttgatagagactttgtaatccttctgagtattttctttagttttctgatgaatccacttatttaaataaaattattcagttaaaaatttttttgaaagaatataaaaattcgctgtttcctgccactgtttactacaagatactgttgatatgtggtaagtgttctggtttatgggaggagaaaggaaagtttaagttcatttttgggaagacacatttccattgacattgaacttgctaaaattgcatgatcacacacaaagtgattgcacagcaatttttttttttagttgctgccaatatacaactatttaaaggctggactatttcaaaagataataatttgttatcaacattcttaggtgcagataaagagcctggaaccatgtctggtaaaacccttcccaatttacaccagaaagtctttggcaaaggtaatcttgtgctgcttagctgaaggcccttcagtatcaactaataatgtagcctgctgcctgctgtcattttttcactattagaaatattatcatattactatttttgtaccttttgtgtaatgttataatagcttctaaaggttttctcctaatattttgagaacttttgtttgcattcttgatttgaaacagtgtgacctgttagtgcctatcggatgaattatactctttgaatgtctctttttctaagccgctgtgctaatacactttttattcattttcccctgtgttataataactatgtttaagtctcatggcaatcttctttagtctatatatgctgaaaagatttatttgcatttctatccagaataaatcaaaataaattttgctggaaatggcatcatgtgaattgagtttctttagcttgcaatttttaatcattgtgctttatctggtggaaatgttaatgtttagtggcaaaagaattgtaaacagtgtttaacacacctttagtcacagacactttcatagaataaagggggttgtttaatactccaagaattactattcttatttgaattttatttctattgttgccaagtcattttttaaaaagaaaaatgatcccagaagtagataaccttttttttttttaataaagcagataaacttactgaaaatgacgtataaaactcaatttttctggtaggtacatactcttttgattaaaagttatcttaaacgccacatacctgaaaacacagttttacccattcaacaatcttgatgttcactgtcactgtgataaaggaaatccaagatattagatagcaatattctagagaaaaataaacaaattatatttccttcccctgatgaagttgtctagaaagctcatccaggccatggggtgagaccaagaagtgagaagttctagtgtctgaaaggaactgcagttgaaggactttattcttagcattatatatatgtatttttttaacctctctttggttctcagatcaacaccaaaatgcatgtgctcaccttctcttgtctttatgttttcagtaggaggaaggctggcattagcaatacaactttgaactcaggaagaaagtttagcctgaaaaagataggctgactagggtaaagtttgcagccttccaaactagcctgttatctttataagtttatgaggtagtaaaatggaaccaacatttctaacagaatacagtcgtgtgagcctgtcattctgaaagggactttatgtgtgctgaggtcaaaatccagtatgggaacccatgcagggcaggatccaggttttgtggcttattagacttgtgcagtttcatggggccctctttaagaaaaagaatgtggaattacaaatgcaaaattagtgaaaagatctcggaaggggcctatgcaaggaaagggccctgtacttaaacttcattaattcacaataaattcacttctaacctcatacataaacctgtatctaataagttaaattgtgaattgataatacagctaaatattttaaaatgagattgaatgtcacattcttgaggaaaccttccctgattgctttctttgtaatgccactgtgtcacatatacatggtgtggtaacgatccatttacccatctaatttgctcattagattctaagctgcagactggctaggatgtcttgcccactgctgtatcttttgtgcctagcacagtgcttagaaaattgtagttgttaaaagtagagtgcagggatgctggagtcacaacaccttcgaacgtattccagcagcaggctcggtgccgtgcctgatgtgccgaaaggtgcctctagtgctattacaatgcagacacagtttccatcaatcatatggacagcagctgccaagttctcttttacttggtgagttatggatggcaaagatgtctttcaactatgcacaaaaattggtaaagaactggctaggtgtccatccgtcaggtaggaaggagtgattataactgatctgaaggtagagtgagatacaaaatgccctctgaggatattttacttattcctgagagctgctgctgtctttgaacacctttgaacatttactttttaagacaattagatcaagggaaaaaatcatggaaagcatgattcaaagatcaaattcttcaatttgatgaagtcacacttcatctaactgggtcattgattttaaaccagaagcctatttactaattttacagcaaagatatttaactgtttctacaagtcatcataataaatgttatttctaatgaacagtgtcttgaacttaaataagagagagaaaaatagtggcatttcctctactccccaaataattctattattgcttaagtttagtgtttataagatttaaaaataatgggtgcaggttgggatgaggatctatataaccatggtggattatttttaatactgagaaaaacataggataaattctgcaagtactatactttttctgccaaaggagaaacatcctaaaacaagaaacttaggggctgatttaagaaaaagctggatgaaagatgtccagaccagctacataatttatagtgcccagtgaaaaatgaaaatgtgggaatcctggttaaaaactgttaatagtttcaagtcagcaacagcagagcattgaaccaagtgtggggctcttctaagcttggggcacatgttacgtgcccacgaagctagcccttatagatgcctttgcgtggttcctgagagctgctgtcaaagaccgtattcaccatgtaacctggtgaattgcaaagaaaaattcacatgataaattcctctttgttctcagcaccagaatagcatttatcacccgaaatgacctattacgttcctgtaattgagcaataggagctaccagaattaaatgttgtgctcaaatgaggtcgttttgctcagtctgggttttgggatgccatttcgttgttgctatttgactttgattttatatgcaatgttaatgggttttggtctttgtgttctaaggcatctcaaatccttttttggaagtagagacagtacgtaagtaaacaaaactcttaaaagtagttttaaaagttgattttaaaagcctatcatcaacattattcactggtggcagtaatagctctattaatgagattaatgcgttccaacaacataattattttttagagactccataactacaggcagaaataatccaggaaagcagaaggatgtgttccacataagcaagaatatataacaaattttaaatagtgagaaaagtatctttgtcttaagcaaagctcaggcaactaaggttaatggaggtgaaggttggggctagtttataattgggaatggaaagcccactggggacaagcttagagcgagggaactgctggcagacaaccctttgctgtggtgatacaggctcacttcagaaaatgtaacatatactcttttattccctgaagtttccaggagccttagctgggatcccagaacagtaaggaaccagtctggccttacagtgtgcatttgtgcattcttccccaatcatcccacaagaattaaattggattgccctttaagcagggctgccatgttcagttgtggaagattttccattgcatagactcattgggtaataggcagtggcatctgcgtttctccccactttacggcgatcaagctgcatcccctctcatggggctgtgctccccactacaccagtcccaagaagaggcaccatatgggctagtgtttaggactacctgagtcagctagataggcttagtaggcaacctaagtattcaagaatcccttaaagtgagaaaatgcctttccttatcaggaataaaaaacattgccaattagagagctctagaaagtgaaaatattttgagttaattttaagtatgaatgagtgctaattagagtggaattttaacagcagtcattctccactttttgataagattatgggatgtgaaggaccagagcctctatgtgggagttgggagctaggaaatgcagaaaattgatgcagaaggaaatagcgtttctcattacgttggctttggtttacatgcctccttcctaaaggacttgttaatttaactattacttgtatatgttaattgaagtactactcgatttgagtgtaattttctctaagtttttcttatcctttggtacaaagaaatcatttgtattccattgttaaaactgatgaaaacatgtgaaatcatacatgaagacatggaaagatacaaactgaaaaatgagttaacattgttgtaatattaaatgggaacaaattaatttccatcgaaggtaaaataatgagtgcatttgtgatttttgttgcttactcatcataattatgagacattatatttaagcacatataaaataagcacactttcacatttaaaactctagtgatcttctgtatggaacttacactgaaataactgccctagctggggtcgtctccctccttgattccatcgggcttggctgccttccctcaatatgtgttgagtgactactgtgtgccacgtttgttcctagaggatccaaaacccaaaccagaagctcccagggttgcagtgtaattaatatggggtgtaattatagccttttatgatagtctgtttctttccttgttactgtagtcccaacacttcctgagatgtgccctttaaccaagtttgtcccaagcctccacatcttaggaaaattataaacttttctgtgttctgtcttttctgtaaaacctttacctgtccccctagttggacctaatcacttcctccctggtgtttcacagagcgcctcaaaatttacttttctatcgtagttatttctatttgtgtttttatcccccactaggtttcaatgtccctagaggcatggattctaatgaattcttgtatctctattgctcatgatatttgcagaatgcatttctcataattggtacttactcaaaaatatagcatattacacaaatcagattggattacaataatggtttgcatgccaccagttcagggacacaggttgttgaccccaaatactgtagagccaggttgagttactgtcagcattcttaattcatgtttactgcataacagaaaatttaatgccctttgcccaattcctgaataaatccactattatcattctctgctcccctttctaatctgctatccatgcaaacatcatttccattaatttatgagcataggttcataataaacagttttgcgtgctgtactcttctctcagatatctaggagactcaattaaactaaaggaataagcaattttgtctataagtataaacttctgaaaaattgttgcccccaaacagcctttaaattctgagagaagcatgtctagaggtttcttatcaagcttcagaaagtacatccttctgaacatttttaatggcagctcataattgctgcccatatacatcagaggattacctaaactgggcttttcctgcagtgaaacagtgtctaataatttgagatgaaattctaattattttaatgagatttttctgcttcttggcatcaagcaatttgttttacacctttactcattatttttcatttttgaggacttaaatagaagagacatgacagaataggagtcctgtttcatctcttggaccattaattatgccaaggcggtttcagtactgatgagaccccaagaggaatgaatctttttgggtcttacttggtttaacggatttcattctttatacttcaaacaagttttcttagaaaaccattaatcactaaactatggattaaatagtgacaataatggaaatataaccaagaacaaattgttcatggttggtttctccaaggatttgacagctaatttataaaacaagttgtttttgttcagcaggacttttgtgactaaagtaaaattgctttggcaaaaggctcagcaatattctatagcctgtaggggaacggagcacacacagaccttcctccttctttcttgaccctctttccttgccactttttgcaagatttcaatttgcatacctgtcctgacttgttgccagcatgtgcccttgaaacagttactaagtttgctagtataaaaggttctgaaatttgttttatcttgtcaacacaaggtccacattggagagctttcaagacatactgtaggaaacttggcaaataggtaaaccaagtttttttttttcttaagtttggtcttcattttatatagtcatctgcatcaattacattcatagtttcataatccaaacaaacactgacataaaatatgtaagggttgctttcttaatctggacgttttcacctttgttggttcttcagtttgcctagctgggtgatgtgtgttagattacgtagttgtgtgtacaaagcgagagctttctcccttccagacacatgttatatgagggaggcagtgtaccaggtattacagagtgctggtaattaagcctgtgctgggaaaagtagggccaaaaccaagaacacatcttggatgcttccctcaagggtcttaggtgtagttggggaacataattgtatttaaaattgtgaataacagtaaaaagcagtgactgataaattgccaatatgtagaagagagaataagtgttatagaaatctagagaaggggtaggtaggctagagtggccaaactaatgttatttcttagaaattgaactgaccgttttcctcattcattcttttattccatctactcatttattattaaccaccttattaataaaaagcagctaacctttatttagctgctcaggcactgagtattatatgtacaactcatttaatatgccatcgttttgcagattaggaatccgaggcatagcatttgaccaacttgataatgagtggaagagactggtgagaaaccaagtctgtgtactccagagcctggctcttaaccagcatgtcctattgttttttgcctaacatttgctgacagcttgtcaagtagtaggttcacagagacagctgggatatagagatagtggaacaaaatccctccatttgagaaaccacagaagtaagtttgaaggccaaggattctgttgcaggacagtgatggtagcttctgaattcaggggaggcacacctgtgggaacatttggagatggagagaaggaagttaatgaccaggtggtagaggactttgaaagccagaatgtggggtttttgtttcatccatagcttcacatgtcatcttaggaccctctatttgggatccccccagagcttgtgaaaaaagcccctttgggatcctttgcccagagctcttgttcagattcttcttaggggtagggctctgaaatttgcattttaatcaagcaccctagatgattgttatcccatttgatgtggaaaatcactgctgcagataaaggagtacatatggtaaaacaccatatttgtttatattttaatatgttttgcttaaatgaaaacatttttgtgtggtataaaaaagagaaaatctttatcactttatcaaaatctgactatcactatattgaagtttaccagaggtatattggaaatatacctccgagagacccagtatgtcttataggcagtggtattctggtaaatgttttaacaacgaactctctgaaaacaatgcacaagttttgatttgtagcatttgttgatttcaaggtaccaacttaatgtcactgaacatggggttaggaagagatgtacacagttgggtccggttccccactgcctaactgcctatgagtttgaccagtgagtgaccggcagtattagaagtattagtgagtatttacaagaaaaaatatttatatgtatccaggttttataaacttttaaccacttaggctgattggaagttatttgcatcataacttaactttaatccttaactattttcaaagcatgatctcatacattacctttgaattttgcaaatattctgtgagattgccatggcagggaagatattagccttattttgtagtcgagaaaattgagagcaagtaaatttaaagaacttacctaaggtcacaatgctattaagagacaaagactgattatttctagtcatttctcttcactgtatactggatcaatactatgtaacaagctacaggttacaaccaagggggcctatgtgtacaatgctaagatactgacactaaggatatagtgaaatcataatttgggtatattagtagaggtgcttctacaactgcacatttctttgcattatactgtatgaatcatcgtcaagttgagacaggtagggtactccttccaccctcactggagttgttttgttgtcaaacgcagagatgataaacttgagagaaacagttcagagactggaaaaagaccaatgaggagctaatgtcacctggaagagtcttatccttgttccagtggctctcattgcatgatccctgagacctcctgcagcatcagcatcaactaggaacttgttagcaatgcagatccttgggtccccacctcagacctgcacacactgtgggctgtaatcgacaagtcttccaggtgactttgttgcttcctgaagtttgagaagagccctatatcatcccctccaacccagaaaccctagagaagtttgtgggatcttaaagaagagaaggcatgagtgtcttattccaagttgacagagtttaaatcagaagtaactgagtagtcactaattagattgcatttacttgaagtgactcaattaagttgtctgctgttagctggaattgggggtttaaggtaggaattaagttcagtttacggaaattaagatagttacacatcatacacacctgggtttgtagcttataaaatagaattttctatgtacactctggatgcacttgcaattttgtcctggaatgaaccaaacagatgaagtgaacagacagaccttggtgcctcatgtagtgtcaggaggtagttcatacacttggccgaattaagactcatgatgtacggctgtgggggtgggggcgacaaagcttttgaaatggcatgctgtggcaaaatatgatccacgtgagttttccttggcctttggcaccatggactctggccccctaccccatggccttgacttccctgacctgattgtgcttagtgcttctcctgcagcttggcaacgtgcatcatggtctcaactagtgctaccgactcatcccagttggcttgagactttctcagttttaacaaagaaattcccatgtcccaggaacctcttagttctgggcaagccagtagagttagtcactctgttcgtatcccacttgacttaagacctccactgggtgttttctttgctttttccactggtgcaggttggtcccgcatctttggcaggctggcaaccccagcttacactgttgttggttggggagccagggcaactggctacggagagttgctgtgaaagagtcaactattactttttgtacatgtaagatttgtaggaagcatgattagaagttatttttaggctgtgttgagtatttcttgctgatttggaaatatctagtcacatgtaactgacatagtaatttaataaattaccaactgcaatttattaaagcttggaaacatcttgctgtggagtgacttcaattaaggaaaatcactttgagtggaatttgaaaacttggcatggtactggggtattggttatttcgaataaatgggtgatacctgaaggtggaatcttaagaaaattaattctggcatatgtggaataaaatagagggattatgagtatggaggctcatgggagaacacatgttagtctaggattgagatgataaaggcacactagggagttaatggtcagaataaaaggaaaatttttgaaagatattttgaaggaagaacggatgaagtactgagctgggtaattgagagaatgatgacattattaatgaaaaataagccagcctaaatttagacaattgcaatgaattaaactttaggactggtaagtgtcaggaactcagatgatttcaaacagttaaggatttgagataaggcccaggagaaaggtgtgggctgcatatgttcatttgtgagcatcttatcaaaggtgatggttgaagcactggagttggtgtagtattcttgcatcagtaggtaggtgatcatcagaagcagacagctgagttgagtaatgtcaatggccataaatcttttgtttggtccttaatacatttggtgctatgaaattaacatttattcaggattttattgtggttccttccatgctattttagcagtgaaatttcagtgaaccaattagaacagtgaacttgattgcacatgctaatgaagatcttcttaattaacttttaataataaaaactccaagttctcaagagctagtttacttccataatgataaggaaattagagtttgagcataccaatagtagtgtgatcccttgatttctacagcatttataatttgcaaggcattttattattttatcaatgaccaaaaccctttgggacagttggctttctctctaatttatagataagtaaactgagtctcagagtgagtgcgttgcttgcaaaggcatgtagtaacatcagtcataaccacgtcagattgtcttttagttctttgaccgatgaactttccacagtgccataattgctggttgccacacattaacactagcgtagtgggaggttcctccagtatttccccagcgcagtgtagatttcagaagcttttgatgacatgccttcattaatcagagaaagatagaccctctatatatagaagttttgatggataaatatatctgacattgctataaggcgttagtaccacaatttttagattcagtcatcttcactgagaacccaggaataaaattaggctgattgagggcagaagaaggctgagccaattaaagaaaaccctgggaagccaggattaagtagcacaaagacaaagatgagtgagctgatgaaattgcacccctagctgaaaagcagcacacttgaaggaaaaccatagaatgttccgctaacttttagcagtgggagttacataatctaataattaattgtctgtagcttccagatctattagggaggtgtggaacagactccagaggcaaatcactggctcctgtgcaagtcaggaacattgccttaggcactcagcttcaaattggtaatgtttacaagttgttttccccataattttttaactctgggcataatctttttcctcttaatgggtattttaagtgtatcttaaagatttttcaccggctttacacttacgattggaaattgtctagtttgtcactatacttctgagtgtcagagtacacatcttatttttgttttttttttccccctaaaagacaatgttcaaaatacaaggtgatagaatatccctggcacactggagaaaaactgagatcatgtgcaaacagaaggatacatccttttaaaatagtttaaactgccattagaaatagaaggaaacccattttatctgggttactttgacagatgtaactctcacaaaggatgaatatcaaccaccagcaccctcttgtctgacattctgacttgaaaaggaagagcccctgcaaccacatagcatggagaggagataggagagaggctgtgagtagatgaaggctttcagtcatcaggggccataggtttcgttttgatgtacataaaagctgaccaaggactttgtgaaaactttgggctgccttcctgaccaccttggtttttttccttcacccgtagatcagcgtcattgacaactgcattcttttcaagtggcaaaaagaagttaaaaataaaattctattttagatgtacctttgattttcttcaaaaacatttcagatgacatgaaagagaaatacgtgataaattttagcagagacctggcagagtcttcctatagtttaatcaaaaatgggctcagtttcaaatatattaagttgccacaggagaatgggaatgacttttgggaacagttaatagttcctggaattttaatccccttttatcacaatactgggtaaaagttccaaggtaagtaggcaaataatacttaaaggaatattgcatgaaatgtaagaggtgacgtatttaaaagaagtatccttgtacagctcgcctttcctgtgataggtgctgcatgtttttttttttttttttctggataatttgtcctggactttgtccaggacagaaaacttcggtgtttctaaagtttatttagtcggtctcatctccttaacaatgtcagaagaaaccttttaacttggaacttggtaaaagtaatagaaaatattgtttaagatctaaatgtaagcatttggggtgaattctttaaaaaagtctggctatttcctagatttataactgcaaatactgtacaattaaaaccaccatggtattcctcatgattcttcctatttgggtattgatgaaggccttaatcaaccatagctgtttagaattttgagtgtagattgtaatttgggatattttctactggggtcctggatttgcattgtgttctgatttcttaccctatactgcattttcccctatggaaaaagtaccttccttgtattggaattttttaaaagattgcagttatttgtaatttgtaatcccccagtgtttctagtttatatctttaatgttgaaatatgaagaatattttattctattttccaaacagctggtaagagaattcctctgagaaaaaaatatctgcctggactctcacagtcgtctcctaatttatctttctgcttctgctttccatgatttaatttttttttgtacagtatccagagtgatcctattaaaagtcagatcacgttactcctctgctcacaaccatccagtggcttcccatcttatcagaacaaaatctagaaaagtcatcctcttccacggttctataagtgatatgcacctcaaatctttctggcctcatctgtaaaaaccctcttccttgttcattctactccacactggccttcttgctggttcttgcatacagcaaacacagacctacttcagggcttttgcatttccctttatctcttctcccagaaatttgcattatttgcctctcctcctttctttcaggtctctgctcagatgtcactgcatcattgagaccttccttgaccatctgaagttaaataggaccagtacttcaggtgtatacagagtccagaccgtgagatctttgatctcagaaattaggagatacccttaggggattagggcttcccaggttctagaattgagatggtcgttctttctaggtcttaaaggccaggggaccccagctaaaatttgggtaacttcaaaatacaaatactttcacttaagttacactgctgtttatcaactatgtgtctgtagttatttagtttgttaattgttactccacaaaacaaagtatatactgaaaattcataaagcctatctttttgcaaatgaaaatgtgatctaatggtctctttgtgaattccttcttggaaatgctccattattgtcatagttggtttatagccttccttggtgttaaaaagagaaaagatgttttctctttccattattgggagctcttttctttctgttgtttctgttcttcctgccctgtggctgctcagattctgtgtacagctgtttctatgaagtaatctgtgatctcctcacgttgctgcctctttgttgttttcactacatgtagaccacagtgtcacaataagacaagagaataaaataaaatgtttcctattttattaatgatttaaaagtccaatgccattattcaatgaaaagcccaagtcaacaacattttagtgtaatttagtgagaagtgttctggtcacttggctcaaccatgcctgcaagccaagtttcagtgtttcctgacactgaatcgcctgagtaccattgtggttatacatatggtgggatgacgtggccagttgaggtatatgtattaatatgctgaagaaaagagagtagtggcacttgcttcgtgagccaaaaaactgcaatcacttttaaatatatgccacaaggctgtgctgggatatgaaggaaggtaagatagagcctaggtctgtctagggattgggctgcttctgttatataaccacagcaagtcagttcagggattttagcaaacctttgggaatagcagggactgagctttagatgatggctctgaactgctggtttccaaccactagggtgctctacctgtgtcagattttcctggatcccatgcatttccccagtccatggtaaaggaatcactgggtatctgcttgtcattccccaatacacagcattctaccacattctgacttagaatttccttaccactattttccccccactagcctctgaggagctttctgaacatatagcccaactccttgtatatgtaaggcatttgttacactttgatggagaaatgaaattgtgtgacttaacaactattatattttcttttcattaatccttgtactatatttgcatgagtagaattttgtaaggttgtaagctctaggttactggaagaaacagaagtccgattgatttgttctgagaaaaatgactggataacaaagctaggcatatagagttgaatttaaatccttgagatgatctaacctgataatgtaacatcatccatctgtaatattttctcagtcaatttttctggtattcttcattttctttttgagaaagtgaagcatatatttatagcattatagcatatatttatgccattctctattcttaaggaatagagacagtattattttctcttcaatctgtatttcatagtgacatcaaagtaaaattctacttaaattgtgtgctaatcatagctttttatgttttcccttttctgccttctacttttttctactatatctccacttcaggtgcttctctcacattttccttaaatgtttctgtcagttccttagtctctacaattcaagagatttctatgaatctcttggtctattatgtacctttagaatggaagggtcttactagaaaaaaaatatttttatctgcatcacatttgttgacagaaagagaccttcatgctctgttgttaggtgcataaactagcacaaaacaatagatactgagtgctctacttctggaaaaacaaatattttgttttagctatttgcatatgaaaagatgtggaaggttacttatcaaaatattaactgattgagaatgtttagagtcttgttgattgcagttttccttctttcttttttccccactatttcatgcattcattcacatagtcattctttttctgtgcatttttattttctgattttctgtattactagtgtaaaagcaaacactaattgggaaaatatacaggaaaaaatgttcgatggatgtaaagaaataattgtgaacgtttatagcaccaatggtgctacgaaactattcttgacttccttttctttggttctaaggactaaagcataatccctacttctttggagctttggagggcttggattgtgtcttcctcttagagttagaatgatccatgttttgccaaagtgttcaagaaagggccccatgttggatgtcccttacagctttacctgggcatggagaaggcccagtcacacagtgatgacttgtagcctctggacaaatgtcatagaatggctgtgctccttccaaattccactcagagtggggacagctctactgcttgctgagcagtctccattcagaagtgtttcccttaaataatatggcaaaagccaaaaggtaagattggggaagaaaacgtggacctaggctaagatcatctcctctcccccactgccacctacatgtttgttttgtttacttgaatgaaacatggagctgttttaaatgtctgtgtaacacagtggtatcaataaaatgcagcttagttaaaaaatttattttatttttctatctgtgattacgttaagcttccgtgaaaatggaatgcaccagtttcacagcaggagaagatagatacagcaagattagggaggcaagatgttcaggattagaaggatctgtatggctgaaagtgaggtaatgataatgattatgtgataatagtactgttgtgctgttttgtgaggcagtaatccagctcccaaagcagataaactatgggggagaaggctgagtttatcccatggaggggaatagactgttgctgaatagcccagcatgacagtaaggctctttcttttttgaggcaagagctcaaaagtaagtttttaaaataaaacgagtaacttcccaaatacgaacaagtgaacagctgagcaagggtaaaagaaaatccaatagtgcaggagggtgaggggttggaggggtggggatgggattctttttatgcaacaaaaactggagttctagtcatatgagaaaaaaatttcagggccaaacacaaaaacaaaacccccctactatgcaaattggcagctgaaatgaagtggtattttctagaaaagtattaaactactgcaaaatgcaaacagatttccattcatctcattttaaatcactatttgttcatttcttgaaaacttgcttcatggaagggactgtaattataacagacaaatggcatattgtccttgacttctctgagcttacagattggtattgcttagtaagatgttgcggctaggcgtgctggctcatgcctataatcccagcactttgggaggccagggcgggtggattacaaggtcaggagttcgagaccatccttgctaacatggtgaaaccctatctctactaaaaatacaaaaaattatctgggcgtggtggcgggcgcctgtagtcccagctactcgggagcctgaggcgggagaatggcgtgaacccgggaggcggagcttgcagtgagccaagatcacaccactgcactccagcctgtgcgacagagtgagagacagagtgagcctctgtctcaaaaataataataataataataataatgttgcaatagctaaatcttcactttttcttttgtattcaggattgactggaaagtaaatgtcactcagtctgaggattcctccttcctgatatatatctatatctgtatctgtatatggacataacatatatatacatctctctattatctaatctgcatctatctatctatctatctatctatctattgatgcattccaagcttattcagttctagaaaatggaggagggatggaactcagtcctcagttcatactgatgtgacttctcctgggctccttgcttaggcatgtggggccaatttgatttggatgactccactggcagctggtttcactctaggacagctgggaaaattttgcttcatctcccaaaggtttactgcttagtactaattctttctcccttgcaggctgccagcaggcatccccttgtggtatcgtcacatcagaggctatgctatcaaatgggttcatatgtcttccaacctgtagaattgcaacccctgacttttctatgtatctggaagctcttagacaccccaagggatggagccacttctaacactgagacctcctcttctcctccatcttcaaacaaaaactctagctcagtagcctcatgggctgtagtcccagctactcaggaggctgaggcgggagaatggcatgaacccggactttgacctcccaatgcaaaggcccatttagcctctgggggagcccaccaagatagaacttcttttcaacttaatcactcaaaaaggctaacttcaaggacactgagattaccttcaatgttactttttgggagatgtgagaatgagaaacaatagctttcatttctcttcattgaagctaaatttgagaagaataagattaagttaaattctcaggagcttattctgccaccccgaattctccacaaagtccctcctgtacttaagaagagggagttttgtgctcgtttgttcaccattgaatccctaacattcagcaaacctcttggctcaggaggcctgatatatatttttgaaataatagtgaatgaatcaggcttaatgtttccagaagttagttaccatgactggatcagtcattgcttatatctgggaacactgaagagcattaattcacagataatcactgagtctatgtaccaggtgcttatctgggcacttggaatctgtcactgaacacaagggcaaagacccttgccttcatggagctttcattctagccaaggagacaataatcaatgaatttattgaaaaagtaagttatctagtatgctaggaaatagatattatgggaaaaagaagggttgagcagggtaagggagatacagagtaaggagcagtttgcattatgaagtaggtggttggcctcattagataagacagtgaacagagacttagaggtggaagggagtaaagtggaatttagggcaagagcactctctgggcagaggaaacagctacagcaaaggttggaagtctgcttggcatttttactttagtaaaatacacataacaaagtttacaattttaaccatttttagtgtacgattcattggcatttcgtaaattcacagtgtgcagacatgactactgcctagttccagaacatttttatcaccccaaaggagaacccatattcactaaatagtcacccccccattcccaccttcctcagactcccggaaattcctaatcttctttctacttctgtggatgtctttggcattttggggaggtgaagaggctcatgtgggctggagtctagtaagtgaaggggagtttcgtaggggagaaagtcagtgaagtaatgggggctgagccggatccctggtaagccactgtaagaactatgacttttactctgaacaaaatggagaacattccagagttttataccgaggggcaaaactctatgcaagagtaggtcgtatgtgtgagacagggtgagaggcagattgactaggaggttatcagtgtaatccaggtgagaggagataatggctcagaacagggtagcaagagtgagagtgctagaaggaattgaattttagtaagattttgaatctaggaccaagagaatttgctgtaggcttggatttgggatgagacagaaaggagttaaggattctccagttgttctaacgtgagcaactggaaggatgtagttgccattaactgagacagggaagctatggctggagcaggcttgcaggggaatatagggaatgctgttttgggcaggttgagtttgagatgtctggtcatctgaataaaggtgtcaagcagttagtgggatatgtctgtctggagttctagaaagagttctgttgtggagaaaaaacaacttgggagtcattagcatagagatggtatttaaagctatgagaatgggggaaatcgctgagggattgagtgtgaactgataatgagaagaggccacgtggtgagcactggggcatattctcctttagtggtgaggggcacagaaaaaaactataaaagaaagaattgaagtaggagaaaaatcatgggtgtgtagtgttttggaagccatgtaatgaaagtaaaccaaggaggagaggtcaactgaatgagatgctgctgaagtgatggacagttggctttagcagattgtggttggatcaaaagtcatatgggaatgggtttaagggaaaatgaaaagaggagaattgggaacagtgagtagggacaaatatttggaagactttctcataaaagctgaaaaaaatgagggcagtacccccttcttcggtgcctcaccttcactagaaagctccatatttcttaattattctaacaaataattatagttaattctggtgagtgatgcatttctttgcaaaatattgtctcagtttcttcctcacagtttctcaggatgctctttgtcatcatttaaaaagaataataaactaatgagcaagataaggagagaaaagaaacagatctgagagaagattctctttctggaacactaataataagcttaatattttacaaaataaaacacttttaaaaactatcctgtaaaggtcttatttatgtactttttataggttagcttataactgtttctataaaaactaagaaaatgtggaaaattttgaagtcatggggagaatatctgaatagcttttcctcctagtttcttggaaaaacaggaaattatatgcaagactcattttaaggcctttacagtgtttaatttacttaagtacataaaaatgtattatgtataacttattaaatgtattatgtataactaataaagtcgtgtctgggataattaaattttaaaaatatggtagattaagaaagcaattgcagatttactaattgaatttgctatttgatgtttttaattttttaaatcacaaatagggttctaaagttgttgcagtgaaatgaatttaacatttcttatatgctcaattaattgggaagcaggcaaacacctgaacaaccatcatactagtattgcacataaatagatcctgttttagctagttttatgctcgtatgacattaaaaaattttagagacaagttttctggaaaagtagctgtatcataaaggggagaaagcccttgaatgtattgaacatggtgggcatgaaacttggtggaattgttggcagtttttgaggtgtcactttccacagtctcttcaggcacattggttcatgtctcattccttctcgcatgctactctactatttcatttgatcattgttttacaatttccgaatgaaaatcagcttttttcatgcactacatgagagggaggaggctaaaatgcaataaatgatcttagaggattggtctgtaaaagtcttctcaccaaggctgtgggaaggaacgtttcctccaagaactatttggcttatttatctgctatgtgccaagtattatgctaaattctgtggtgcaaagatgagagctagattcattcattcagcgatttattcattcagtcaacatttatgcaaaatcatttggattattcaaaaaatatataaagacagtcattatcctgcaacaattgaaaatagagttaaagcttatttttgctttgtaatttaatcaaataaacaactatgctacttgctctaacttacttttctggctttttaagtcttgagttcaaactactttcagctggaatcttagggatacagttgaggacagtgctattataccagttttcccaaagctcataaaaaaatcctaattaatctttaacttatattctttacattttcatattttggtatatattttcttaaaacaagaaaaatttagtgaattcttaaataaaataatattttcataaaatctttcttcagtctgggtgtggtggctcacgcctgtaatcccaacactttgggaggctgaggtgggcagattgcttgaggtcaggaatttaagaccagcctggccaacatggtgaaaccctgtctctactcaaaatacaaaaaatagctgggtgtggtggcacgtgtctgtaatcccagctagtcgggaggctgaggtgtgagaatcgcttgagcctgggaagtggaggtttcaatgagctgagatcatgccactgcactccagcctgagcgacagagcaagactctgtctcaaaaaaaaaaaaaaaaaaaaacaaaaaaaaaactttctgaacagatctgttttttaagtgggtagttttacaggggagaggttatttcctaacgttccttcaagtgagcaaatctgtcagagtttgctgctccccacaggcacctaccattctacccccaaattaactctttcttatcaatgaaaggtatttccatttttttctgggagagaacaccaattaaatagttaggtaatttggtacctaatgtctttaacatttcttattaataccttatgaattataatattataatcttccttttaatgaataggttatactcccctgcaggtggaacacttagatgagaagttgtaaatatctttaaaataagggtttaattaattataaatatgcctgctaattttaggcaggattctactctaggaactggaaaagaaaccaagaaaataaatgtcttttcagctgtgaagtaaataaccatctagtgagagcaacagagtgagccccacattattcaggtggaattggattaaaaagctctgccagtgagataaaaacaatgggatcagtggtggactattgaaataggaaggaaaaccataccttatttagatatgatactcgtataaagatgttgaaatgcttttatttctctgcattgtcatatgattcaagttgggatgggcccatgtaagatagatgaagcagaagagcaaacagcattgggtttagaggcaacatctaaaacaatgtgattattttgcccctcacagaaattagtgtctcagtaaaagtaaatacatttcctgggcaaccagaaacatatgttgcatgttctttccagtacagtatgaatcctcagtaagacaaaaagagaatggttctcactaagcaaaccttccaacttttatgtccctgagccttcagttgctgttgttggttgttaacatctggctttccatcatcccacttttctcactcatagttgtgggcttactgtgggtattccttggtagtctatcaccaacatgagggcaagattagtagatcaaaatcttgtatgtttaccacttagctgagagccttacacatagtcactgctcaataaatattttttagcaaatgagttaccacgcaaatctcaaagcctttcttgtattaaattctagagtggtctttgaggaatcaccacactgtcttccacaatggttgaactaatttaaactcccaccgacagtgtaaaagcattcctttttctctgcaacctcaccagcatctgttgttttttgactttttagtaatagccattctgactggtgtgagatggtttctcattatggttttgatttgcatttctctaatgattagtgatgttcagcttttttttcatgtttgttgggcacatgtatgtcttcttttgaaaagtgtctgttcatgtcctttggcctctttttaatgggtttgtagaaataccatttgattcagcaatcccattactggatatatacccaaaggaatataaatcattctattataaaaatacatgcacatgtatggtcattgcagcactattcacaatagcaaaggcatggaatcaatctaaatgaccatcagtcatagattggatagagaaattatggtccatatacagcatggaataccatgcatctgtagaaaggagtgagatcatgtcctttgcagggacttggatggagctgaaagccattattctcagcaaactaatgcagagagagaaaattaaacaccgcatgttctcacttataagtgagagctgaatgatgagaacacatggacacactgggaggaaacagcacacactggggcctgttggagaagagtggtggggggagggagagcatcaggaagagtagctaatggattctgggcttaatacctaggcaatgagatgatctgtgcagcagaccaccatggtacacatttagctgtgtaacaaacctgtgcattgtgcacatgtacccctgaacttaatataaatattgaaggaaaaaaatacaaaaaaaattctagggtggactttggagaagatggagggcagggagattctaagaacaaatttttgtgacactctaaaaacaaatgaaagtgacattagtcattgagcttttgaattttttctggtaggactttacctgcaactaaagaaaaaagatggacaacctttaatcttgtatcacatcaatactgtcattaccttgtataaaatttccatttaatgcatgttctttaactatctgagtgataacaggtgaatgacatttttgtatatgcgtatgtggcttacatatttcccaattctgcaaactaccatgaagttagtattagaaacttactttgttatggttagatgagttaaaggagggaaattagatgcactgtatatacgtatgtccccgagagtgcactttccatgaatgatggcttgcatcttctcattttcctagatttttcacttctatcactatcatgcaaataattacaaatagcaaataattttaaatgtcagtaagctagtcttgagagcatgcagcatttactgtcatagagcaaaataaattaagtagaagatgaagtcttctgccttcatgaagttagcattcagtagagaagttgggacaaaaaaaatatgaaatatttgttgccatctacaagagaaatgtggaactacaaccatttgcagtgatcctcaagtcctgaagtggggcaggagtcaatgtggccactggttccaggaatggcctggagaactacaggcagattgtctgaaagcagagagcatatcaaccttctcctctcttcatgggtaacagatgcaccattaaaatgtgaacatcacacatgtaaatcttagactttaatgtttttataactgcaaaagtatagcttaattagacatatataatgaacctatcctatatgtaggatatatatcctacataccctaaggtgcatgaaacataggaatgacttcagaaatatcaaaattaggaatccttctctgttgccatgttttgaaggtaagatttttggagttgtatataattcattttttaacactttgaatgtattactttgtctcaagcctacttaacaccaaagcacattcataaaagcacttagctaattgtgaaagctagtaataactagggaatctgaacctgaaatcacatacttttttttttatttttgttgattattaaaagagaaattaagttatttgctcatgtttatattatggtaggtaaatttaactcccaaaccacaatcttacataggtagacttgcaccacgggactttgctgtacacattatttcatcacccaggtattaagcctagtccccattagctatttcttcgtgaccgtctccctcttccatcctccaccccagtgtgtgttgttcccctctatctgtccgtgtgttctcctcatttagctcccacttacaagtgagaacatacaataattggttttctgttcctgcattagtttgctaaggataatggcctccagctctatgttcctgcaaatgacatgaccttgttcttttttatgactgcatagtattccatggtatatatgaaccacattttcttatccagtctactgttgatgagcatttaggttgatcctgtgtctttgctgttgtgaatactactgcagtgagcatatgcatgcatgtgtctttataatagaacaatttatattcttttgggtatatacccagtaatgggattattgggttgaatggtatttctgtttttaggtatttgaggaattgccacactgttttccagagtggtcaaactaatttacactcctaccaatagtgtttaagcattcctttttctccaaaacgttgccaacacttgttattttttaactttttataatagccattcttaatggtatgagatggtatctcattgtggttttcattttcatttttctaatgatcagtgatactgagctttttttcatatgcttgttggccacatgtgtgtcttcttttgaaaagtgtctgttcatgtcctttgcccatgttttaatggaactgacaaaccacaatcttgattgcttaatacaataaaggattatttctcaccatgtcaccatccagtttgagttagtattcgtggtaaggggacaggtgttgggaacctttgctctgcccaatcttttaggaattccgatttcttccactgataggcttcactatcaaggaaggctgtggagtccccagtggatcctctgcatttggcctggaaacaagggaggaagaagtgtggaggattgtgttgaagggttcatttttcatccagaactggaggtgctagccatcacctctgaccacctttccttagccaaaatttaatcatgtcattccacttaacttaaaggagcctgggaaatgtaatctagccctttgctggggaggaaaagaaaacagagttttgaaacatgcagcactgcttctgccatagtgtttaaacatcatgcattgatgtaaaattttctggactttcaatatacatcaaaagtttccagcttaacacaaagtcaaatgaaaaaggaatggccaaaaacataacaaacaagaaggaaggcatatcaaataaattggtgaatttggaagcacctattttaaaagaaatggctgtccaaagacagttctagtggaaatgaaaggcaagtaactctatttcaaatcttggactaaatggaatagtgtaaagagttacctatctaggaatcctcattaagtagccatacacccttggactattcacttatcttctctaagacttgattgccttgtatgaatagtggacataatgctaatatatgttttcatgcttgctttgaagcaaacaattatatatatgagggtgtttgtgaaatattaattgctaaacaagttttctttcaggctagttgcattaaggaaaaattacttccaagaccacctgtaatattcacctatgactcatgaatttccagttggctagagtagcatagaaaggctttcagatttgtaaaatcaaggtttatctgaggtaacctttgctgcttgttggaagtatgtagctgagtaattgttcaaaaatagcaggttattttgaggtagaacatatgttctttaacaaataaaataagtgttctgaagggaaattttatagcatatttaatcacacacttaaaataatttaaatctggcagtttagagcactgtgtactttgatatgattttttaagtgctttattaagtgcagtaatactaaggtgagtactattgtgtggatttgcattttatgagtagctcttttcaacttctgtaaagaaaaaccatgtcatgaataaccaaaactgaaaaatgtagactaaacattttttatatttgatatgttttataaaattatgaatatatgctttttatatacacacatatacatatataaattataggtatgataaaagtgacttgtttcataagtcaaacaagcaaagaacccttttttatttatatcaacctgttaatgcatgcctcttggttgttggatgtattcatttaatagacatttaaagactaagttgttgttggtagtagggagcccagtaggtgttttcaggatattaacaaaaagcagccataacttccagcacagagctaaacacatagctgatattcatacacaagaaaaataaaatgtagtcaagccagtattttggaattggtcaggagacagataagtggtataaatatggcagagtgagattctttttaggttggagagccgggcaagacaacatcatgaggaaggaagtttttcattgattcttggagaatgggaaaaatttagtcatgtgacagccataagtcagacagggagcatggtatgagcaagacaaagggaggagctgtttgatttgcctggagaattaaataagtacaagaatattggaaaattattcagctcggaaacataggttgtggccagactgtggataaccttaaaagcccacagctttatggatagttttgatgatgtgacattgatgagttttcttttctttttctttcctttttttttttttttttttggagatggagtctcgccctgttgcccaggcgggcgcgcggtgacgtgatttcggctcactgcaccctctgcctccaggtttcaagcaactctcctgcctcagcctcctaggtagctgggattacaggcacgcaccatcacgcccagctaatttttgtattttgggtagagacggggtttcaccatgttggccaggatggtctcgatctcttgacgtcgtgatctgcccgcctcggcctcccaaagtgttgggattataggtgtgagccaccatgcctggcccaacattgatgagttttcacaactcatcatgtgatgtgattaaggaagcattgaaagcacagtttaaaaagccttaattgctgagatgatttcatgattattgttgtttctttagaaaccttgacatctcagcatatctaggacttttcttctctcaatatcttgaagagctaatttcgtttgcccccgtttttaggtttccacttcctatttttatgttgcgtatctgagattattatacaatgccccgtattttagggttcctacaaaagatagtaatgctgttgcttaagcagaaagtaatattgattctgactacgtggaaagtggggtggtaggtgaagtgaggaacacacaaagatataaaaccatgatgttataataataataatactgcataacatttggggaatagcaaataaataggatagaaaatacaattctgtaggagtttggagctgtgattggattttagaggagctagatggaagagttgaaaggacctctaactccaaaactgagtaatgaaattgatggtgtattatcaaggagcttcaggtaaatcatgcagccaatgaagagccttttctacctctccaactagtgtttctgtggcattgctttagcataattcattgtcatcagtaatgggaacaatcataaggaatttttgaagctgaatcttttaaaaagtaattgtgttaataaaaattttagttgctttatagtttttgcaacagataatggtggaatgtttaggaactgtggtgggtatattttctgtttcttaaaagttgaacaattccgttcttttattttctagttccattgctctcttatttgaacaggattttaagtttgtttaaaatacataaatgtggctgggcacaggggctcatgcatgtaatcccagcactttgggagggcaaggtagggggattgcttgagcccgagagtttgagaccagactgggcaacatagtaaggccacatctctacaaaaagtaaaaaaaaataaccaggcatggtggtgcatatctgaggtcccagctacttgggaaactgaggtgggaggattgcttgagcctgggaggttgaagctagagtgaaccgtgattataccactgcacaccagcctgggtgacagagtgagaccctgtctcaaattgtgtatgtgtgtgtgtgtgcatgtatgtgtgtgtgtgtgtgtgtgtgtgtgtataaatatataaatgtaacaaaacaaaaataagagaagaaaacattgggtcaggtgtggtggttcacacctgtaattccagcactttaggaggcctaagtgggtggattgcttgagctcaggaggaggatcgcttgagctcaggaggtggaggtcgcaataagctgtgattgcgctactgcactccagcctggatgacacaatgagaccaccctgtctctctgactctctctctctctctctctctctgtctctcccacacacacacacacacacacacacacacacacacaaaaagaaaaaaagaaaaagtagcataaattaaagatgaagttctacatagaatccaggtgctaaggtactatccattttgtataaataaatgacccacatacttgtctcttgagttttctgttagccacacaaaagagtgaacggtaggaggtttataagattggcactgtctgtagtataaaaacaaaccagctactcagaaagagcacaacccttcctaataccaactctaggcagaaataaatcttttctgtaggttctctgagagaagccccatagaatgtaatgagtaatgaatatccttaaaaacatccttacaagtagatagagaaaacttgttttagtactttaaaaatacatgtttataatgctttgggttaattgcataatgcctaagcatcatccagaaaaaacttttacagaggtcaaaaaaatgtgcactagacacaaactgtaagggagggacttagagccgggccagtcagtgtcagttcacactgcagcatcatctgtggcctcgttagaaaggcagactctccaaccccatctcagacccactgaatcataaccttcaaggcactgttgagaagcacatattaaagtatctaagttgacttaaaagacagttagataagccttcatgaatcatatttcccttaactgagtttagataaacattatggagcagtaaatttggagatttttctttgtgaaaaggaaatgaaataaatataaattcttttactggttaagcgtagatctattgcttttgcctttacccaaacattgggaagggtgttagacattcagttactatctaatatgggtgaagcactgggttaaatgagagatgtaaagatgaacaagacagacatggtaactgtttcttttatttattttttatttcagtaggcttttggggaaccggtggtgtttggttaaacgaatactgttctttagtggtgatttctgagattttgttgcatccattaccccaagcaatgtacactgtacccagtgtgtagtcttttgtcccttaccccagtcccaccctttttcccaagtccccagagtccattagcaggggcaatttagttgtaaacaagttgagggaaggaaactgcaaggtataaacaaagtgctgtgatggttatttctattctctagattttatacagaagaagaaactagctcagagaaataacttggtttagattacacagctaatatgttacaaagttaagaattgaactcaaggtctatgtgatactaaattcagtttacacttctgaaatatagcttcttgaaagaaaagaaagggaaaactattcagaaagtgagaaaaatcatactataaatcagtagcttctctattcaactccagtattttagacaatgtaataattttgaattacatctcctggagcaagtgctgtttttagttaatataaactgaggtgactcttgcagttttcctcaggaggtaataataaagtagggattcttcttctcctttttttttttttttttttttttttttttttttttttaaacagggtctcactctgtcgtccaggctggagtgcagtggcatgatcttggctccctgcaacctccgcctcctgggttcaagcacttctcctgcctcagcctccccagtagctgggattacagacatgcgccaccatgcccagctaatttttgtatttttagtagagatggggtttcaccatgttggccaggctggcttgaactcctggcctcaagtgatccacctgccttggcctcccaaagtgctgggattacaggtgtgagtcacagtgcccagccaagggattaaattttgccaaaataaacagtgccatgattgcagtcccctgccaccccccaataaaagtaagattttattgatatatgaagacaagcctgttttttcttttttgaaacaggatcttgctctttcccccaggctagagtgcagtggtgcagtctcagctcacagcaacctctgcctcccaggctccagagatcctcccacctcagcctcctgagtagctgggactacaggtgtgcaccatcatgcctggctaatttttagtatttttttgtagagatagaatctcaccatgttacccagactggtttcaaattgctggactcaagggattcacctacctcagcctcccaaagtactgagattacaggcgtgagccatcatgcccggccaacaagccagttttatcctcaagtgttgtgtgaggattcatgaagtgtttagcacacagcaggttttcaataaatattgattgaggaaaagaatttaatatttaccctttagatcacctttcgagcccacttttattgggtaataaaagagtagaatgaaaggaatatatttagaattttaaaaatcttacctcttttagaaacattttatagtataccagtcgtcatgacaatatgtgaactccccatcactatgtacttcatacttcagttggcattggccacagtttcccccatatcatactgatatgtatatttgtcttatattcccacaatagtatgagccttttagagagatctttatatttttctttcctatatgggctactgttaggtgtgtgtactcagaagatggtcattaagtatttaaatgaagaatgaatgatgatcactacaattattttaagtcaaatctgatctagcaacctgtgcctttatagtgagttcccaatggctgccttttaaacctggtcaaagccttgctagtcaaagatgatctatgaccatgcttctgagtatttttagtattgctgttgagagggctagcatttacggggtgctaattctgtgacagacacttttttttgtttttttttttgttttttttttttttgagatggagtgaactctgtcgcccaggctggagtgcagtggcacgatctcagctcactgcaagctccaccacctggattcatgccattctcctgcctcagccttccgagtagctgggactacaggcgcccgccaccatgcccagctaattttttgtgttttttagtagagacggggtttcaccgtgttagccaggatggtctcgatctcctgacctcatgatctgcccgcctcagcctcccaaagtgccgggattgcaggcatgagccaccgcgcccggccaacagacactatttaaaacattatttcctttagtcagtacaacagtcctaggaactcttactgtctgtagtggagatagggaaacaggtttataaggaattaataatttattgctcaagagtaagagtaaatgaataactaggagataatgaatgtcctggccatttattctcaaagagcatgaatatacagaataggctgatttgagacattatactgctttcttcctggaaactgactttggtggaatggtcaagctcttactttagaagtcataaagagctgtgtatggagaaggtaacagtcggtatgttaaaacaacagatccggccatagaataggtgcctaatggttctgaaatataagcaaacatgctggacaactttatcattatttctggcatggctggctctggggctcatgtttgtaatcccaactctctgggaggccgaggcagggagattgcttgagcctaggagtttgagaccagcccgggcaacataacgaaaccatgtctttacaaaaaattaaaaaaaaaaattgggtgtgcatggtgatgcaggcctatagtcccagcagctcaggaggttgaggtgagaggattggttgagcctggaagttcgaggttgcagtgagccatgatcatgtcactgcactccagcctgtgtggcagagcaagaccctgtctccaaaataaaaaataaaataaaataaaacatagttgtttctgacttagcagaatgtgttatattggaaactctatgcttctgtgaatccagtactgcaactctctcccactcatttaagaataaatccttaagaatcccaagaaataaacatataccacagttcagtccattgggccagtatatttataggatagtcacacaagtccagaaactgtcaggctgttactctgtgagaataatgggaagggttcttatcttcattcccactccaaagtaaggtttactttctagaagtgagatgcaatataaagtacccacgcaaaaggtttgaggcttatgcagaaaacaagcatggattaggatagttagggtttcatggagcatactttttccattaacaccaagaagataaatttagttgtctttttctgctagagctttgtggaatggagttagtgaagtaaaaggcatattccctttgtttttgttgcagaaataaatgggcaaggacactttaaagatttcgtgtgtgcattgtggctacttgtcctaaacataaaatcatacaactaaatgaaaatctctctttcaattcattttaacatagtgatttgctgcttattagtgcaatctggcaaaaaatgttagccaagcagctaatattttgtttacatttttgccctagcaaagatatatcaaatcccctgatgtacacctcttactcaggtattattgtaaaaatcaacaaggaccatttgaacactgataatactaaaaactgtcggttcccttattgtttctttaaaaataaaaccaaaacaaagcaattaactgcaaagggctatagtaacccaaagcaaagtttacatatttaaacataggggagtaaggaagtacagaagttaaacaacaagagagataatcttgaaagtggcaaaagtgacttatctcacttaaaagagtctcaataaggctgacagctgatttctcttcagagaccatggaggttagaagacagtggcatgacatattcaaagtgatgaaggaaaggctatcaagcaaaagttctatctgtagaaaaactcctccaatttttaaggagaaattaaggcatttccagataaacataacctgagagaattttccactagtagacctgttctacaagaaataccaatggaagtccttcaggctgaaataaaagggtattagatcacaattcaaatccacatgaagaaataacactaataaggtaactgcataggtaaatataaaagacagtataactgtatttttgtttgtaacattttttcttctgtctgatttaaaatacaatgacattaaagcaataacgataaaactatgtgtttggctaatagtgtattcagaagtaatttgtgtaacaataacacaaagaagagggtagagaacagagctatttagaagcaagattttatatactattgaaattaacttggtattaattctacctacattgttataaattgagataatattaatcaccagggattaagaaaacaactaaaatgcatactaatagaaataacaagggaattaaaatgatacattataaaatacagattttttataaaagaaggcaataatagagaaagagaggacaaaaagacagcatatagaaaacaaataacaaaatggtagacataaatcctaccttatgagtaatttatttaatgtaaatgtattaaatagtccaataaaaaaagcagatgttgaaagaatggataagaaaatattatctatttgtattctctatgtaagagacacatatgagattcagagacacaaattagtaaaagaatgtagaaagtaaaagaatggaggaagatatgccatgcaaacagtgactgaaagagagctgactacactaatatcagtatgttgtgtgtcagacccaatagattttttttaaataataaaaccgcatttttatgttacaagaagattttatataatatctgcatgatataccaattttctcataatctcttctgtaatattatttcattaacactctggtccacagcttgattcaacaagatcaggagggcaggcaggaggatgttaaaagaaaggtactgaggtgtaaaaggaaccaaacatttactgactcaggcacctattcttgatttctgttcacctgttgccttgaacaaactgcctgagctcatatgccttacctccataaggagcatgacctttgggaatttaccaggtcctcatccctgtggactcagaatcttgcttggtaagagtttataattgactttttttttttttgagaccgagtcttgctctgtcacctaggctggagtgcagtggtgtgatctcagctcactgcaacctccacctcccaagccccagcaattctcatgccccagcctcccaagtagctgtaactacagacatgtgccatcacacctggctaatttttgtaatttttctgtttttaagtagagatggggtttcgccatgttcaccagtctggtcttgaacccctggcctgaagtgattgacctgtctcagtctcccaaagtgctgggattacaggtgtaagccaccacgtgggcctggctgacacaatagattttaaaggacaataattttactacagacaaaaaaggacatgttgcaatgataaaaggctcaaaccatgaagaagacataggaattgtaaacatttatgcacccaaaatgtatgacacaaaattgacagaataaaatggagaaatagaaaatttaacaataatagttggggacttcactactccactttacataatggacagaacatccacaaggaaatagaagacatgaacaacactgaaaactaggcctaataggcatttccacccaacaacagtggaatacatattcttctcagtgctcaaggactattccaggctaagccatatttgctaggccataaaataagtttcaggaaaatttaaaggaccaacagcatgcaaagtatattctccaactacaatggaatgaaattagaaattaaaaaaaataagaatttagtaaattctcaaatatatgggaattaaacaatatactcccaaataaccaataggtcaaagaacaaagcagggtaaacatacatgtatatccatattaatgaattaatttaaagaatttttagtcacattatggcttaaaaataatttttcagtattgtccaaataaagtacctcattgccatgatgaaattggatacgggagatgttagcttgctaaaaatgacatataattattatgtaagagggacattaaaaggctaacaattaattttgaaggattaacattcttattttagaaaggatgactcctgttaagacattcttgcctatgcatacctgctgtttggattttctttctaatggaatagactagtttatattactatctatcttattgacatctcaaagcccttggtttaaattgatggttcagttagacaaaatcttaacttacaaggaaaagttgtttatgcaagtgaatttagaaatttagctatctatacttttaaaaacattggcagtatatctcagtggtatgagatagtccacatctttttatggactttttgttttattataggctttagtgccattaagggaaaactatttagttactctaggaatagccaaacattgttcccagaaatgcttgtgttatgtctgtcatggtacattgttaagttcagagcacatgtgtttaggagtctcaatgctggctgaagaatggaaaggacttttattacaaatagtggattttatttaattttgaatttatattaaatgatgaaaaaataggtcctgcaataatttagagaaaacctgtctcttcagggcaaggacaaatcaatattgagtgtttcaattgaattgatgcactttcaattataataatcttcatggtagttgaaaggcaggcccaagcaaaaatcatgatatgcacaaaaatattgctggaagcactatctgctattagctatctgctcatgctgtttaccttcacggaatttctaggttcaaaatcagccatttatttagaacgccagagtacccaccaaggaagcatattgtatagttttgttctgacgaagcatgtggctagaaaacaccagaaattagagttggggttacaaagagtctatgcacatttcttaagtctgagaggtttttttccttatgataattcagtagattcctataaatgactctttagtcacaagtttttttcatttagaagaaaattaaaggtatttaaataaataaataaataacatgcccattacatgttaacatgagaaacttttttaatgaaagataaacatattttcgaaaaaaatttaggagagtagcagtgtttgcattgttgcaaatagctttgatatttaacttaatacaagacagctggattttcatatctgcttctgcatgcaatctgtagcaatatgtgtttcaggttgagaatatgtggaaaatttggccttccacagataatattgctcaaagaggaagaagtattttaagaatctttgcagacaattatggagattattctataataccacaccgaaacttcaaaagtagtagttttctaaaggttggtcgcaatgtagaagctgacaccatatcaataatttttaatactcttattacattaaaatttgttggtctatcttgcactttgaatgggctttttaaccatgcttgatattgcatcactcactggtcatttggaaaaaatgtgtgtcactaaattatacagattttccaaatgctgacacacttcattgtacattatctaacaaaacactttcattaattacaccatttatctcattagaaaattctaagtattgacaagatatcatggtggccaacgcacaatttcaaaaatttaaagttttccttgaaagttctaattttattagcaacaattactctcagttattttccttaccgtgacaggcactttgggttcatttttgataagttataggccaaatactcaggtctgaataatcagttaattgaatcattcaagtaaaaatgttttttctgtttttaagaaaacagctagtttggcttgcaactcaaacaattgcacaagtacctttcctcaggacagacattgtgcatctgtatgcagcaggaaggctttatgtgcacgtcccatctcatcacacagaatattaaaaagatgcatgcccaacagttgacattcaataaaattaattttttcctgtttcatcaagaatattagtaaataaaatatatgttgtaggttttttcctaaaggtgggggtacagttttaagggatacaatgactgtaaatacactgtgataccactgccttgattgttgataattgacagcagcagttttacctgccatcacttctgtaccatcggtgcaaatatcaacacagtgagaaaacatataacatcttagtcttcttatgaaagtcattttgatgcccaagagcccatgtgccatgctttttgagaactagtgctttatttatatttatgatggagccatccaattttagagatgcaaaaacattaggtacataggttttaagaattttcaaactgagaaaaaaaaattacaaaaatcacatatttaggttttaacctgacttctgtgctgttcagctgtgaaaataaaaccatgttattaatataaattgtgaggggaccagtctacagcttctgtactccaaagtacattttgctaaatcaaggtcatatctaaaagacatggctttattatgatagtgtagtttagaaacattaaaacttatttctaaatttattttaattgactttataatgtataatatgttgttttgaaacatgtatacattgtggtgcagctaagttgagataattaatttatgcattatctttcatactactttttttgtggcgagaacacttaggaatatttctcttgcaatattcaatactacaatgcatttttattagctatagtcaccatgacgtacaatagatctcttgaacttattcctcctatctaaccgaaactttatatcttttgaccaagagctccccagtctcttccccacaacactgttattagtacctacccttctactctctacttctatgagagtaatttttatagaattctacctataagtgagatcatgcagtatttgtctttctgtgcctggctgatttcactgaacgtaatgccatctagttttgtccatgttgttgaaaatgacaggatttccttttatttgttaaggctgaaaggtattccgtgtatatgtatacatcacattttctttattctttctttattgatggacacttagtttcatttcatactttggctgttgtgaataatgctgcagtgaacatggcagtgcagatatctctttgacatatttacttcatttccttttgatacatacccagtagtgggattgctagatctcgactggaaatattttgtgcttctgcttctgtccttacatagctgtttatgatagacaataaatattaggcagatacctaaacactcttaaaataccaacaaaaaaacctgtgacaccattcttatagtatttccaattttactctttctttacatagtacttgatagaatgctgagcaccctgacttaacacaatcttaattgatgttggtgctactcagttattggaataatttaaaatgtgcctttcttgatcaattagtattttcattacagctcacttatttaattgatctaatgaaacactaagcctattagaatgtgaagaaatcaaagagaaatgtagaaaatattttataaaattcatctaacatatccactgtgctgtgtattttgcagctattttcaaaaagtttatgtccatgtccatgttttattgacacacatacagtcgatacatacattgcttgagatgatagtttctttgatggctatatcttatttctcatatacctgtaatatttagcacatagaatttgcatgaccaaagtttgttattagtttgaattttaaattttactttatgggcataagtttatgaactcatttccagctgagtttaagagttttcaagtgccagagaggttgcaagaaccaaattaaaaaaaaaaaagttgttgctgaaaattctctcttaggctcaagagcctcaattttcaaatgtggttgattttaattaaagtttaaagagaaaaagaaactattggaaagatattggaactaaataattcacttgtagtgaatagggagtttgtggtttgagttaatagtattcattacactgattaaaggcagtgagccattttgcccttgtttattttccaagccagtgtttccagtaatggggggtggctggtatttgatgttttatgtaatgaggtatttactgatgggctactttgacttctctacttaaatggataaccacttgaaaggaactgatcagaagaacagtttcttttctagagctggaccatttattccaaactcagacagtaagaaaacaattgaatagcttttattgccaccagctgtgctgtggttatttgaacaaatggaagactaaagtaatggtacaatctcattttatacagcattacacaaaatcaggattcttttgcctaataaatattgcatttatagttacttagatttccatcattatgatgagtttgctgccctttgagggttaataagtgggtctatcaaagttaagtcttctggaagttcagggaatgtgctgcttcagggcttatagcaaattcatgattatttgttttgcagatatacacacatatatacatacacatatatggaatatgtaacgtggaatatatataaataaaactctaaactttgaa

SEQ ID NO: 382 - DNA, 361619 bp, Homo sapiens
ggagaatcgtgtattaggagagaaattttctattcttatcaccaattacaagatgccaagaaaagcttattcaataaaatatgtggtgcaattgtgagattcccttcattgcaggtgagaatattcttccaacagagttgaggtcaaattctcccagcagttaccgggtgactctgtcattgtgagcacaatgtaagtaagcaagaagttgggttttccaggccctacagtatgcatctgaatagcactcatcacacggtttgggggaaccagtctcttcctctttactagaggtgtaactagggcaggttattgaaactctgctaacctcagttttctcactgataaatgtcctaataagctcagactactataacagaataccacatactttgtggcttaaacaagagaaatttattttctcacagttctggaggctggatgtccaaaataatgggtgctggctgattcagcttgtggtgagggctctcctcctagcttgcagaccgccaccttcccattgtatcctcacatatggtgaagagggagggagctctggtctctgttcctcttcttacagggatgttaatcccattatagagacccccactctcatgacctcatctaactttatcagcctcccaaaggcctcaccacgcaaataccatcacattgggggtaagtgcttcaacatatgaatttggggggaacacaaatattgagtccataacaatacagtagggatgatgacactgttgttggcttctgttgtttttgtctgctcagcatccctttccttgagaagcagccatgcaccatctggtgctggggagaggcactgccaatgccacaagtcccacctctctggtcatggagggggccatgaaattcaggcccagccagtgatagtgacctatccttttagcctcagagtcaggctcaaggttgtgaatgtgactcaaataaggtcaatcaatccttctctggggtcttatttacagatgatgagcgagaccctgactctttcctaggcccatgagctaaaaaaaactatgggcagccatggtctccattgcacaggagagatcttgtctgtaacaggaaagaataaaccaaaaagagctgagaataaggggatcagggagagaggaaggggcccgtaacagtggaggagacacccacccttgtcatccctgaggttaacttcacccttagacttccctgtgatgcttctttagcattccttttcattggcattagttttggttgtgttttcatcgattggaacttaaaaagttctggctaaataaaatattgactttatagagttgtgaaaattaaattttgtattatgttaagggcttcattatcagagcctctggaaaatggaaagtacttaataacttatggctaattgtattggtggcccttctctctgtttttctggaacctggttagtaaacggtggtccctgtggtccagtggcattggcatctcccaggagccaattagaaatgctgaatctcagacctcacctaaaatctgctcaatcagaatacgcatttggcaatgtccatgcatgaattgtatgcacataaagtataaaaagtactggcctaacaccaaaagcacaggcaagaaaaataaaaatagacaaattagactccatcaaaatttaaaacttctgtgcatcaaagtgcatagagtgaaaggaaaatcatgtatctgacaaggcgttaaaatccagaatatataaggaatgtctacaactcaacagcagcaaaacccaagtaacccaattaaaaatgggcaaaggacttgaatttctccaaagatgatataaaaatggcaataaacacaggaaaaaatgctccacatcactaatcactaggggaatgcaaatcaaaaccacaatgagatattgcctataaccattaggatggctatgaacacacacacacacacacacacacacacacacactagcaagtgttggtatagatatggagaaattgaaatgcttgtgcagtgttggtggaaatgttaaatggtgcagctgctatggaaaatgtatgaggtttcccctaaaaattaaaaataaaattaccatataatctagcaattccacttctggatatataatgaatataattgaaaacaggatgtcagtgagatatgtgcttgcccatgttcatagcagcaatattccaagtagccaagaggtgaaagcaatgccagtgtccactgatggatgcatggataaacaagatgtggtatatccatacaatgaaatattgtttagccttaaaaaggaggaaaattctaatacatcctacaacattaataaaccttgaggacattatactaagttaaataagccagtcataaacagacaaatactatataagttcacttatgtggggtatctaaggtagtcgaattcataaaaccagaaagtagaatggggctgtgggggtggtgatgggggaatggggagttgttcaatgggcaaagagttttagtcttgcaagatgagaagttctggggatttgtctcacaacaatgtgaatatacttaacatgactgaattgtgcacttggaaatggttaacactgtaaattatgttatgtacgttttactaaataaaaaagaaataagacgggctgggcgcgatggctcacgcctgtaatcccagcactttgggaggctgatgtgggtggatcatgaggtcaggagatcaagaccatcctggctaacatagtgaaaccctgtctctactaaaagtacaaaaaattagttgggcgtggtggcatgcacttatagtcccagctactcaggaggctgaagcaggagaatcacttgaacccaggaggcggaggttgcagtgagccaagattgtgccactgcactccagcctgggtgacagagcgagactccgtctcaacaaaaaaaaaaaaaaagaaaggaagaaagaaagaaataagacaaatgtaaacaaaacaagaaaaacactgacctgctacactggggttctttgatagaaaagtctgaaaatatgagatgttacaagtggatggcttcctaattccaagtagaaacactcagatgtgtaccgtggaagtcagaaagtcaatgagataaacagacttcacaaacaagtttaaaaagagttggtggcgtgaatgtcactggcgaagattttacaactagcagtcttcgtctgtcgcctggctttcacagaacttaaaaaaagcctcataatttaagtttgacttgtctcttcgatcactgttaccgtgttctttatagtaaatgtagtcaggattcttttgtaccctaactagggcaagtttgtttttggaataaatgcagccctcaaaatacagaagaactctgttccagaaaaatttatttctaggtcagttgaatacaagtttgaactcatttgtagttgaaaacaacgctagaaatagtctttaagttattagatgtgtacacaaatcttacaacataaaagtgcttaagatgaatttcactcacagccagtgaccacttctaacagcagaactttttgcagttcggagaaggagacctgagacacatttacccttcctcaaccacccagaggggattgtttgttaggaggctgccaaggtatagcccagggggttggagatgacctgatgtcatgctgcctccagcacagttggattttggtccttggcttttccctagtgtcattaaacacatcccctaagaaaaatgctcactctttggcctttggtcatcactgatgagttctagatctctctatcagaagtctacaggcatcataattagctagaaagggttctaagcctaagactcctccctctttctaggattctgttcaatgcagtgtagccatgaagattctctctttcaaaagagacctcactattctgtcaatggctgggcaagtgcccaaagcctacccaaatggaaggcttctgagaagcctgggtggagaacacagatttgcccagtgctcagagcttctgtgggaggctgaataatgcctccccgaagatagccatgtcctaatccctgaaatctgtgaatgttaccttgtggcataaaaaaaggatctttacagatgtaattaagaatcttgagatgggcagagtctcctggatgaccaagtgagtcctagtcctaagtacaatcacatgtactctttgtaacagggaggcagagggagatttggtaacactcagaggagaaggtgacttgaagggagagcaaagagaggttggaagactctggccttgaagacaagagattagaagatagcatccccacaagtcaagggatgatggcagccaccaaagggtttcctgttgacacctcgattatagtccagtgattctaatttctggcctccagaactgtgggagaatgaactgcgattgcctgaaggcagcaagtttgtggtcatttgttatagcagccacaggacatgaatacagcccccatctgccacctgcatccatccttggcactctggtgcatgtgctccgagccaagtattacccacgtggctggctgcaaggagacagaaagcaaggacaggctgtgatacctgagcaggaagaaggacaacagggaaacagaagacctattgcactgatgagaaggagaagggagagacctgcctttacagcacaatgtattaaaatatgacaccatgaattccaggtttccacaccgtctcccttcagggagaaggagcagaatagtaacaaggaattgaaatcttgtgtaccagacgatcccatcactgcctttaccacctcccatggacacattatggacaaagggagcttggggcacaaatagtcctcctttctcaagctttatcttgtcctaaattgatctcattatctcccttgttctgtctctacccctctcaacttatgctgccttccgtgcccccactttagtttatagcatcatcatcatctgccctatatgtacccaagagaagtgggaccaccctgactccccttttttccatcctgccccatatctcattagaaatgtaagccctttgtattatccactgaacatatttcattgataatttttcctttttcattctcattgtcagtccctaattgaagtcctctttcacaggagcttcaccatatcccagtccgatcccactacttccctgatggaaacccttcagtgggctcctggcatgtttcccagaaggtcccagatctctggcatcactctctgtggtttgaacttgctttctttcaagattcacctgtaattttattctgcttttcactataaactgtagactatagttacacttaagatgttaccatttcctgaccatgccacgcgatttcatgacaccaagtctattctccttggcataatgtaccatggcttccccagcagaactgggggcaatgaaggaatgaagccctacatcagtgctttcctttaagactgcagggaagaaacatggagaacaggcatccaaaagggcaggtcaccccggtggccatacgttgccctcagtaacttcagccccagagtccccagcaagtctcaaaatcaacacatttggccgggcgcggtggctcacgcctgtaatcccagcactttgggaggccgaggtgggcggatcacgaggtcaggagatcgagaccatcctggctaacacggtgaaaccccgtctctactaaaaatacaaaaaattagccaggcgaggtggcgggagcctgtagtcccagctactcgggaggctgaggcaggagaatggcgtgaacccaggaggcggagcttgcagtgagccgagattgcgccactgcactccagcctgggcgacagcgagactccgtctcaaaaaaaaaaaaaaaaaaaaaaaaaaaaaaaaaatcaacacatttgctccaagaggctccaggtgatggcttaaacatctgattcaccttatctttttcttccagaatgtatacattcatcccttgtttaaagaagtttggtttactttttttctttaatctacctgagtttagaagatgccagtctttgcatttagtaattgttttgcagcaagttaaagaaagcaacacttccactccaagtctataccaccacctccttgtgctcctcttccctgagtgtgagtttctgcagagaaggccctcaaatcccccaccccagcaccaatgcttagtgcttccttccctgctggagtgtgtgcaggtgggtaaggactttgcttgatggtatagtagatatcttagaacacagttcattcctctgtcaaaatgagtctgctgatatacagctgttgattaaatacccaagctttgaattgcctaagcattttcccagaggttttagcctggaagtcactaagttgcctgtgagagtcaagattacattttcccccgataccagaagaaacgaaagctcatgagttgttgagtgcagctatggagaaatagaatgtcacctctctgtacaggtaaacttctttaacctcctaacatcccattgggcagaagtcatgtctgtcccctgagaagggatcagcttctctcccacatggatcacactttaggtcaactttcggacccaggtctacactcttacttcttggaaagcaggttgttttatccaaagtgttcttcatgcgccgtagcgacttctgcaagaaaagtctatgtacgtggtaggggctacagtccatcccacgcatgccccatggaagaaaacccttctgcatcctgcttttctgctgctgggtgattggaattcatcactggctgtctccagttcagaggtggcccacaattgtagcagtccccgttaatggataatataggatgttttgcatactttggccaaatatggttgtcattttaatgtatgaaccgacacagtctaagatttaggtctttcctgaacttcattctggccctatcattttatgcacattctgtaaatgcgggggaggagacaatgataaggaaaaagcatggaacttcacaactacaagctctgaaagggtctgctctacagaggatcatcagacattcctggtacatatcctatttggatcacactgtgcaaccagtcctaggtcaggtggcagaaagggttgcctgccctctttatgaggagaggaatctacttcttaacctgcttgctgaactcttcagtgacctcacctctgacagcaaagtcatggagatctttctggccaggtttgtaaaagttaggtagctagcacggcagctctgagaaaacatgagagtgtgtcctgcatccactttttgggctctgtagcaaatttgggtgctgcctaagggaatgaaacaacctccctatgtataacctgatctctctaattgtaccttaatttgcttatgcagaaaatcactggaattagagccacacatcctgctcattctgactagtacttcatccagccaagtccagtaactatgggaagggaaagcagctgagggtcactctctttcggaaaggttttcatctgcttgcaaacccacccacacctctgccttcactcctgtaatcaaagatgcagatctttcttagggcaattaggtctattcatctcctatttctattttcagtgtgcctctccccgcaacacccaaacactcaggtcagttcttccacccatgaaagcataatgaatacttacctacctgctctgggcacctctggaatttcagcaagcaagtatttgataagcaaagactagtttcctgttaattatactcagaaatatgactcatacaaaagaagcacaaaactaattggaaaaagaaataaaattaggcctgagaaagtaagaaagtgaaatcatgcaatggtaatgggagaaaaaaatatccatgatgataagactgaattaatagcttagatgagtgtgtgtcgggggagcagggagggatgatacacccaggaagtgatcatagagggtggagatttgcactgacatatgagtcatgaccaaatggaacaataagttttgttttatgagataaaatgtccagccaatttagtccaccatttaattggttttactgatttttttttcatggagttgactcatggttgtcttcttcgttttccctattaaattcctcctccctattaaattgtctggtttgcattaagatgataactgccccactcttaaagatgattggaaaactggtacagaggagagaaatccgtcctggaaataagacagaattttctaaagtaggatgatggagggcctttctgtaccataaacaaagaagggaaggaggccccgcacggtggctcacgcctgtaatcccagcactttgggaggctgagggaggtggatcacctgaggtcaggagttcaagaccagcttcgccaatacagcaaaaccccgtctctactaaaagtacagaaattagctgggtgtggtgggtgcctgtaatcccagctactcaggaggctgaggcaggagaatcacttgaacccaggaggcggaggttgcagtgagccaagatcatgtcactgcactccagcctggatgacaagagcgagactccatctagaagaagaagaagaggaagaagaaggagaaggaggaggaggaggtggtggtggaggaggaggaggaggaggaaaggtaacagagatgttgagggcatttataaactgatgagtttgggtgctccttggattgaaagattcctaaatcagctaatccctttctcctcagaattatgtctttctgtatagcagtctgtcctccaagttgggaaactgggagttaggctacctgtgtagtcttctgattttactaagaaacagaaaataatggaacagggaacacacagagaggaaggaaccaggaaaccagttttccccatcctgatagtcactcttctgtttcccacagctgcttccttcagcagtaacgtctcaccattgagtggccagggtgtcctcagagccatcttgggtcccttggtggcctgagtgggtaggtcatagtgggtgtctacctaagcccagtagggccaatatttattgaatgactgttatgtttcaggcacattgcctacagtccactaatccttagagatgagaaaacagaagatgacaagttaagtaattttccctaagtttggtaaataaggaaaccgggatttgaggctatctgatgctcaatcctgcattatttctgctaacccaagctgtctgtttcatcaggtaacaatttttttttcaggaactcgtttagattttatggttgtattaggaaatcaagcctagaataatgcatagagtcatgctatgctgagatgtttattagcttctattttcagagagagctagatttgctttttcctggatcaactttctaagttctaaagcaaatgccccaaagaatatttcaggtagagcttagttctccatcttgaaaattcataccacaacccttcttgagtgcctgctaagagcagtttccatgtgaagtgcttggagatgattaaaacacatcactgcctatggggctctcaaggtgaagtgaagggaactcctagagacccagagaactgtacataatgagaaagtgcagtggtgcagctgagcacgggagcctagaaagagcataataccttcaactgctattgattgagtgttactctgcttctctgtctctgcttctctgtctctgtctagcatgcctaagtttgctatttccaagatctggattttggggtataatgcctatctgctgtttttttttttctgtccccctctccccactcttttttggcactacactgtttttcttctgaaaaactgtccttctgccatacctggttcatgtgactctgaagtgtggcttgatccacttcttggcaaggactcacatgagaggcctggcccattggtgtattccacatccctgtccagtggctggtttgggaataggcatgtgacccaagtcagaccagagcagagtaatctgaggacattcagggacctatggagaaagagataccctctttatggctgctgagcaggtaggaggcacagctggatatacagagctcccatagaggacagggtgcctgggaaagaagctgatgtagaagacaaaatgtgggcggggtcctggcgacaactttgtgtcctgggccaggccatatttaactagatgcatggacttgtagatctgtaatcccacaaatctccaacacgtcctttaccctatctcaccaggaagagtttgagtaacccttaatataataatccaactttcatctgctattgttcttgggtgaatagctattcacttctctgggaagttcatgggggaggagtgactagtagggtaggatccaggccttctggtgtccatggttgtaacgtcaatcacaatactgtcaaatgtcatctgaaactcctaacagaggtcaccaacttcatctccccacttacattcagatataagatttctaaaaatcttttttttttttttgagacggagtcttgctctgtcacccaggctggagtgcagtggcacgatctcggctcactgcaagctccgcctcccaggttcacgccattctcctgcctcagcctcccgagtagctgggactacaggcgcccaccaccacgcccggctaattttttctatttttagtagagatggggtttcaccatgttagcgaggatggtctcgatctcctgacctcgtgatccgcccgcctcggcctcccaaagtgctgggattacaggtgtgagccaccgcgcccggccttctaaaaaccttggtttcaccatcaatggttatttgcaggtcacgtcactggtcactggtggccttctcacagcataaaactgttaatgaactgagactgtagacttgaaaaaagtgtgaaatggaaaaacaccaaaacacctgtcttctgtgatgtttgtatacaaccaattatttgcaataatcacaaccggcttgaatacaatataaaaagaacctttccattatactgttaaaagtatacaaatgcctcactcaagtctttcaattaatataaagtatgattgagaaattaagcttgttaactttccacccccattcacctaacgcaacatattcaatatcatatataagaaacctaaaaccacacctaaacatgtaaaactcacctaaacattcatgttctggtgctattggctgtacaagtatgaggagatagcttttaaataaaaatggcaacatatattaagtatatttcatgaggtaagaaattgcatgattacctaagtccttttgatgtaaattgtaccacattttgcctgctctgccggtttaaacaaatccacagccctggaaattactctagatttgatttttgcgcttctatgcaaactataccacaacccatcttgcaaactataccacaatccttcttgagtacctgctctagatttgaactagagcaggttgcttgggtccctaggcctaggtgttcccttcacttcatcttaagcgtctcataggcagtgatgtgttttaataatctccaagcacttcacatagaaactgctcttagcaggtactcaagaagggttttggtatagtttgcacagaagtgcaaaaatcaaatctagagttaactactctagcaccaaatccagagtagttaacactcttgaatacctgctctaaatttaaacctgagcatgtttaaagaaggtgtcaatctgaagaggtaggaccagtcatcactgtaagtaatgaaaagggaagtcagtggaggaacatatatttcttcaaatacaagaacattcccttatgcaagctttcccttccccaaactctatgcaatattatttgtccagtggcaggaatcatgcttaagccattagcatcataaattgcttagaaaacaaagtatggcttatttgaaagatatatggagaactgagcaaattaagtctgtccctgctgttttatctttatttattaatggcaataattctgtcctaatcgtttgtatagcacttagtcaattatgtggcatctaaagctcttcaagtgattttagttaatgtcttcctttttctcctgcacaggcagatgcaaattgctctggggaaagttgtaaggtcaagggcagttgtggtttctgctgttaagggaatctgtacagtcacccctcttcccaagacaagaacttagaattgatgaagtaagcaatcaacagatcacagcagatataaggaaagtactttaaagagacggaatggtttgcaggtgtaggggatgataatggtagttttattggaagtatgagcatgtttaaagaatgcatcaatctgaagaggtggggccagtcatcactgtaagtaaagaaaagggaagtcactggaggaacttggctctgtccatctgagctctgtggccaggggagcagccacgtgggattccaattgattagtacagaacaggaccctggcttttgaggagaggattcacggggataagagccagtgaacctgctgataagatcacttctaccaagcacttcattcctgcaaccaccttcctttctcatttccagttccatagtcagcttgcaactttctgattagaaggtggctttttgggtggatcttttaactaaaggaagaaatgctttggaataggcattttgagttttagtgtttttgtgatatgttttaaaaatattttgtattgtggtaaaataacttgtaattattttaaccatttcttgagtattcaattctgtaacattaagtacattcacaatgttttgctatccttatcactattactagaactttttcattatcctaaacagaaatcctgtacacattaaacaataaaaccccatttccctctcctctcagcccttggtaaccactattctactctctgtttctgtgtctctgtttgttccagatatgtcatctaagttgaatcatacaatatttgtctctgtgactttggctgcactcatttaggacaatgttttcaaggttcacctgtgtcgtagcatgtatcagaatttcctttcttgttaagcctgaataatattccagtgtgtgcacataccacatttcattcatctattaatctgttcatagacattatgggttttttccaccttttggctattgtgaacaattctgctatgagctttggcgtgcatggatctagttgagttcccattttgaatttgtttgggtagatactcagaagtggaattgctgggtcctatggcaagtctctgtttaactttttgaggaatctccaaactgtcttccacattggctgcaccattgcataatcccagcggcaatgcacgaaggtgccagttgctccacatccttgccagcatttgttattttccatgtttttatattaaccattctaatggctgtgaagtggttatcattgtggttttgatttgcatttccttaatgattagtggtactaagcatcttttcatgtgctttttggccatttgtagatctcctttggagaaatgtctactcaagtcctttgcccatttttaaaattaggccttgtgatgtaatttctttatgtgaatttgtgtaacttcttcattaatcaatggaattcttagtcaacttggctgtaggaagggactgtgctgattttgttgatgcaaagagcttggcttactgctttgcagttacttctattataaattaaattgtccctgtagtttatttcagttttccaagccagattatcttgatttatgcctaataggtggattttctcttgctgtactggcaagtctgattctgaacttgtgaggcggtgggtctgaacccagatcatagcatgctctccactttaatgagataccttctgaggttcctggggcgggaactactggctctggatattttctaattaatctgcaagtttcatcgtccagtgcagtggccagtagccacacgtcatcacttaaaattaaattcaggttaattaaaaattaaataggctgtgcactgtggctcacatctgtggttccagcactttgagaggctgaggcagggggatcacctgaggccaggagtttgagaccagcctggccaacatggagaagccctgtctctactaaaaatattaaaaaaaaaaaaaagaaaaaaaaatagctgggtttgatggtgcacgtctgtagtcccagctactcaggaggctgaggcaagagaaaattgctggaacccaggagatggaggaaccaagatcaaaccactgcattccagcctgggtgacagattaagattccatctcaaaaaaaaaaaaaaaaaaaaaaaaggccgggcgcagcggctcacgcctgtaatcccagcactttgggaggccgaggcgggtagagcacgaggtcaggagatcgagatcatcctggctaacacagtgaaaccccatctctactaaaaatacaaaaaattagccaggcgtggtggtgggcgcctgtagtcccagttactcaggaggctgaggcatgataattgcttgaacctggaagacagaggttgcagtgagccgaggttgtgccactgcactccagcctgggtacagagtaagactccgtctcaaaaataaataaataaataaattaattaaattgaagaaataacccagttttttagtttcactagctacatctcgagcagtcagcagccacatgtgaccagcgtctgctatactgaacaacacagacatggaactctcccataatttcagaaagttctattggacatgttaattttttaaaataagcattttttggaatcataaacaatatttacatctaatagaaaacagatgttccccttcctgtgtccaagtgttctcattgttcaattcccacctatgagtgaggggcctgtcatggggtggggggagcggggagggatagcattaggagatatacctgatgtaaatgacgagttaatgggtgcagcacaccaacatggcacatgtatacatatgtaacaaacctgcacgttgtgcacatgtaccctagaacttaaagtataataaaaatatatatataaataaataaaaataagtaaataaataaataaaaaagaaaaaaacaggaaacagagaacaaataatagatggggaagacggaaaagaaatagcaagatgatagatttagatctaaccatatcgataatcacattaaatgatctaaacaccaaaattaatacacagatgttggcagagtgaatagagatgctacctataagaaacccactttggaggataattgacatctaaataacatttcatttttcagccaataaacgcagtgtatctctccgtttctttaggtttttaaattttatcttagcaatattttgtaattttgtcagatttgttcctaagtatttcacatttcggaagtcattttaaatagtattgtatttaaaattttaatctccaattctttattgctagtatatagaaatacaattggttatttatactgatcttgtatctgcaacattgccaagctcatttaatggttctgatagctgtattatagactccataggattttctacatagatgatttgcaaataaaattgtttactttttcctttcaaaaaattaaataaaataaaaaataagcattcttaaaggagctttggaaacaggtaaataaaactgaacaaaacagtaacaacctaaaaaatgactccgtgattaggcaatggattaaagaacaaaattaggacagaattgaaataaactctacagtctgactactagaaaagtgtccattagtattctctgctacagaatcattgtaaaatgctcatgttgtggggccgacgtgaggactcctgagcctagcacatagtgagcgctgtataaggaggtgacggtcctgaaaatgcactgcagagatctgctgctgcttagagtgtagctgactgctgtcctcatactgaggtcatgcctcctgcaggcagctcccagccaacagcagagtgtggcaggctgtcaacgcacacacattccagagaggcgcagattattttaacaggtgattttgacttgaggactccccattggcctcctcaaacctttttggaactgcgctgcagtccaagactcttcctaatacactctttcatccttcctgctcttcttcccagatgtcaaacttgtaacatcaattgaaggctctccccgtttccatctctcctgttctttccctcagaaaatctcttgtgtgtctaatcctatcttaacatcagcttcatggcagacccaaactaaagccaagtgttcactgttagtattactctccagaagacatttcttccccctttccccatgagaagcctctcagaagccttctcagatggaaactctcatgtcagctaagtgaccaccatttcctccatttcaactcacaccttggagagaagctcttgtgagcttctcagatctatcagcacaggcttgttaagatgtcattttggagtcctccagaggtctctctaattctaggctattggtgggggtttgttcttttatcttccattcagttccctgaagtacattcccaatccagatattactgttgcttctgccttctggtgtaggttacttttctttcaattgctctgtgtgcataagaacaccctccattttaatcatgtttcacagaaaaacctggaactactccccccacccccactgccccacggtttcagaaacttccctcagccttcgtgtcttcttccacagcttaatcaaacccttgggagtgctggaactgagttccggttttcagtctgctgcccagtcaatgctcgttcctttctttctgcagaatttcactaatattactccttcaggggctcccattttatttcctagggccatgtctattcagaatatcaccattgcttgcatgtaaaaaatccgagatacatgccagtattccccagactgtattctgcacaacctgagtgttctgaaagctacaagactgtcttgaaagctgtcttgtcagatgctggtgctctgctgacaccttggtcttaccattgtagtagtctggcttccaactgcaaatatctgtgtctctttgctttctcttgctctagaatgctctgtccatgagtgctgcaggtcggatattcctcagtcagtgactgagcagaagcagatgctctacctgggctcttaattactagctagaaccagggtggtgagtcgcttgataacagaccctttcctggctgccttcctttcctcagctcatgttctcacatactcattggcatttcctccaatcatttcccaaataaactccttgtactggaatgaatagcaggggaatccaaactaagatattgttctagtaaggaaagatgattcatggtcagacatgtctgggaactactaggttaaacaaaagcgagtaggtttcctagctgtaaaacttcaaagaacatttaatacgttgatttatttagtgactctccagggatgacaagtagacagaccatacaaagttatttggcaatgtgtgattgtggaatgcaatgcaagtgcaactgtgtgtgtgtgtgtgtgtgtgtgtgtgtgtctgtgtgtgcacgtgcacacggacacacacacccaggcatccaccacagaacacagcttaagaacagctatgatgtggttaactgaacccaatgttctgggaagagcaaggttttgctttttttggttttctcctcatagtactacttcccacaaaatgtataacgctcattaactcaaggacgtacaaatacgaaatgcataaacacatttttaagaagcagtagacgaggtaatgaacagtgcctactttggatcatggattactatggtgtttggggaacggactggaagacaagtaggctcaggactgacattctcatcttgtggacgataatagagctttgttctttggcacttaattaagcagttctgattgttctccaagcatgagaaaatgcatgtggagactcatgttaatggttctgctctcccaataaatctagttacatatagatccttagccaatttactttttcattatagagaggagaaatcataacatagcatgaactagaactaatttaacattgtacacagtttaaaacttcagtggagttgaaattaagatcattgaaaccccacgagaaaatttacttcctgttccaagatacttgggcttcccagggctaaatggacagtatttattcagcatcctaggtgagtctcactcttaggtctaacattgggtcacatctatggggatttcagcatggcttcacacaatctgtccctgccttcacctctgaggcaccaactccaagaaaaaactgtggatataccggtcaaattgggtcttcaaatatgatttactggggtaccagtatgtgtgtatgtatgtgtgtttgtcttgatatgggtctctcttcagggaaaaagacagagacacgcagagatacagagataaagagagagagagtgggagaaagagagagaaagaaataaagcactcacttccctcaaaaactcatacttgaaagctaaattaaaaattaaatatatttaaacttaacaaatggattcaaaagtcactaaacttcatttaaaaggattttagagctggccatggtggctcacatctgtaattacagcaatttgggaggccaaggcaggtggatcacctgaagtcagttaaagaccaccctggccaacatggtgaaacccggtctctactaaaaatacaaaaattagccgggtgtggtggtgcacacctgtagtcccagctacttgggaggctgagacaggagaattgcttgaacccaggaggtggaggttgcagtgagccaagatctcaccactgcactccagcctgggtgagggagcaagactctgtctcaaaataaagaaagaaataaaaataaataaaaaataaaaggtttttagatttcttttcaattttatttttcctaaagttttttgtaggtgacacatttatatcacattgaacaatagatgaaagcatttgcaaacatccatttaaaagtgctttctccataagcagtcattttatgaactgaatgttaatatctgccaccaccccccagttcctgcgttgaaattctaagtcctaatgtgacgctgttaggaggcggagcctttgggaggtaattattttatgaaggtggagccttcacgaatgggattagtgcccttaaaagaagagacagagagagatgttcgttctcttggctatgtgaggatgcaatgagcagatagtcatctgcaaactagaggcaggtctgtcccagcagggggcctgccagtgccttgatcctgggctttccaaaccccagaactatgagaaataaatgtctgctctttaagacttccaacctattgtattctgttatagcacctcagacagaataagacaaattattttaaaattgttgttaagcgtcacctttattttgaaagagaacattgtcttttcctttcaaaatatctaagaagtagtatatcactgtcagttatttctctggaacacttgccatttcattaaggaaacgtactcaaatgtttttttttaatcattttgtcaactcttttaagtattttgtcataaaatagacattgaaactctaccaaggaagactccatctggcaaaaacttttcctggtcattcctgactcattacaaagtattgcactggttttactacattttacaggttgtggcaaacagactccaaaatggcccctaggattcctacctcctgggaatcacaggcctgtgtaattcctcccctttgagtctgggtgggacctgtgacttgcttttgcccaatagaacctggcacaggggaggagatgtcactctatgattatcttacataagactgtaacttgcatcctgctaaggaactctctttactgactctttcccttgctggcattaatgaattatgctgccatatggaaaggaccgtgttgccaggaactgaaggtgtcctctagcctgacatcagcaggagaggaggctctcagtctaacagccagtgaagaactgaatcctgtcaacaaccacagaagcctggaaacagatccttccccagctgggcctcagatgaggccccagccctggcccttaccttgattgccatcttgaaagagaccctgacacataagccattcctgaactcctgacactcctaccactagcgaccctgctttattttcccctagcacctctcaccatctgacatttgatctatgtgctgattaactccatgagagagtaaggctttgctctgtctgctcttttctccccagtacctatactatacagcaatcaataactaatacacatgttttgcattagtttcataaatccaactaatcattgcagcaatagcttgctttcaaaggatgcagtgcttggatttcatttgtgcagctatatctgtaatgctcacctagattttgtttgtaaagttacagtcaagcagcctccccattaggggttccgctacactgtttttccatcaaacattgtttttactcaaaaaaattactcctatgaagatgttttatctaataaatcttccacttggtggcttataaaaaatgtagtttatcatatattgccttgctgaaacaggatctagcaaatatatcagctgaggcattagaaatatctgtactctcatccatgtaataatctaacattttccactgtataatttatcccatacttttatcttcaagattttactgaaatctcttcctgatttgttgacaatgaaaagcattttaatttgtcaacatatattggttcctatgtatccatttagccatttttcttcaagaggatgaataagtgcttccctaatgagggttttgctactgagtaagagacttcaacagatcttctaaacaagtatcattaagcttagtggaattttttaagtactgggctgagtatatagtacctttaaatttaagcaataaataaataaacaggtagttgtttttaggttctaattttaagtgtcctgctaattgtgatgatatcaaggctcaattacacacccagaatgactttcattattaaaggacaatccatattgcaaactcaatggctacatggtctccctgcttccaccctcactccttttgttaatctcagccagaaaaagcaggttatatcctgtcacatccctgggcagagtttccagtgcctcttcctcccgttcataggaatggcctgagtccttataggcccctgcatgacctcgaccttcatcagcccccagtgcttggatcatgtcacctcccacttttcttctcactcactgcttctcatccacactggccgcccccattgcctttacataacaccctgcccgatggagccttgctccccccacccctccttccctgcctttgcaattgcactttcttctgcttggaatgttctccctttggtatgcacaagactcttttcctttagggtctgctcaaatatttccttaccagagaagcctcccccagcttctcaggcatttctgacactggctcccctgccttattttcccctagcaccgctcaccacccgacattttatatatgtgctgattaactccatgagagagtagggctttgctctgtctgctgttttctccccagtacctagattatgcctggcatgtagaaggcatttgataaatatatattaaatgaaagactatatttcagataggtttcttaataataccgaattttttcattggttttcatctcagtttgaatcaggctgtcattgtttttatcttgtcatgtggttagacatattagttgttgttttaccctggttctcttgcgattgtatttttttggttattttcttcagtccacagggtttgttttttggaggattgccttttaaaacagctgctcattgtgtgagaattggctcagcttaaatgagataatgtagtttctaaattcacctaactgggtgtgcataagtcagtatgttttattatatggaaatcaaaccaatgacaggaagacttgatatggaccccttattgccaatggacagccagcctccctcgaaacacctccctcactgcgggtgacacatgaaggtctgatatttacttacagcacaaggtgcattagtcatgggaggttaggctatgctgtggtaataagtaacccccaaataccagtgtctaaacacaattcaagttcatttatcactctaagagagacagcatggaccagacagcttctctgcatgatctctttgcttctagggtcagtgcaatgtgaaaggaaggctgtgatcaggccaggaggccaatcccattggccagatcctggccacatgaattgatcatagctgcaaaggggtctgggaaatataaaggagcccatgggtatttggtgagcattacaatcctctgcctcaatctcaatccatatgcactaaatagtagtaaagtattgttcttttcattttttagtatgaaaataaaatatttcctttgtctacctcaatggataattttgtgtgtgcatgtcatactctggagatcacagctaagacgctgataacataaaacccatatttaaccaatatacaaaatatcatcttgttttgtgattttctcctttgtcttaaaatggaatagaaaaaaatttccagttaataatagtgccctttaagagattttctgaataatcaagctctattgccacattcacacaggacttgcttgtctctcatgtctcagtaagctggtcaatagcattaacaagcacacccttagtgagcagattatcaggaaaggaagaagacaaagtctatgcccatgtttatgtattgattatgctctgtttcaagatcaattctgcacatcatagatggctcgaaggtttgatttgggatggttctgcctaataaggacaaggaggaagtattaaaagcatctttcttttcagggaaatggaaaacaacaaaccaaaaactcttgctgagtggagggctctgatacattgcctgatccccaggcaaaagagagcattgtcagaggctgacgggtgacagtcaggcagtactgagaggaagaagcagaacatgcaaatgagaacaatatgctcttagcaagggtcagggaaggtgccacccatgtcacgggcctccaagatctttgagtcaagggtggaagatcccacttattcaatgccaagctcacccataggtacttccattttctcttagctttccagggtcacagcctttgttatcatctctgtacatggcctcttaaaatgtgtctatggcttaaaatgtgcctcggccttccgggtcctgagcactgacaccacgcctcctcatggggtccatatccccaggcttggacggattctctttctcagacattccaacacaaaagtcccctttagctccatttccctgtgataagctttggctgcttccaaggctcagcacaactccttttgagaaggcagggagtcgcctctgcacctgagtgttgaaggtgactttcccgagtgtcttcaaaagggcatttttctacttaagcttctggaagtgtgcttcctagagctgggttgcaatatctctgttctcaagatgtatgatgaggtcagtagaacgatctatgatcccatgagccaaacatgtttctgcctttactgcattagggacatgctggtactgtattagtctgttctcatgctgcaaataaagacatacctaaaactgggtaatttgtaaaggaaagaggtttaatgggctcgcagttccacatggctgggaaggactcacaatcatggtggaagatgaaggaagagcaaagggaattcttacatggtggcaggccagagagtgtgtgcaggggaactcccacttatataaccatcagatcttgtgagacttattcaccaccacaagaacaggatgggggaaaccacccacatgattcaattatctccacctagacctgcccttgccacatgaagattattacaattcaaggtgagatttgggtggggacacagccaaaacacgtcagataccaatagtgacaatcaccacaaaatcctcacttattccaataaaaggtgaggctcatcctatggcatttcaacgtgttgatctaacaactgcctaccctgagttatcagtgggctgcctactctagcctctcattacgttatgtgtcctgacttgtggtcttagtttatgtatcttacctactgactcctttaatttctgacaaccctaaatatttttatactggtctttcccagttgctgtgcctcagctgagataggatgctacctactaccctcctgaacagcatctttcctctttctactggctgtgtctgccttctctaacttgacttggtattagtgaaacatgactgacaaacccatagtaaaggaagggagaggaagaaatgactccttctgggttatctcacacacttatctgaaaaaaaaatcagggctcatggttcctgcacaaaagtttactaactctatgaccttgggaaagttatttcatgtatctgaaaatcaagattctccatctataattgtggataatatctatcctatccccatgtggttggtctaagagttagagtgaattcacaatgaaatacaaaggattctggaaatgtaagataatgtcactactctattattgaaaaggtcctggtgctgactttagttcctttattttaaaattgggttactacgtcatttacatactgcttgtgtttattatttaaaagtgtcccctcctttttctgtgtctactaaaatcacagtcatgaactgaccttctagttacattttgttgtcattgttctgttgttacagaggaaaggtgtatcattaacttgccttctagatatgaaccaagcatgcaactgtttgcctggcactgtattcaccatttctcagtattcttctactctgcctgtctgtggaattaaaggcccttccagggggcacactgggatggtggagctctgcagatttcagggttgtgggagaggttagagagctgctgggataagtattcatgaacaaaccaggtttttgcagaaacaaactcttcatactgaaaataaatgccactaggtacggaacctcacattttaatggcacaccaatattggtcttgtatatgcatatcaaataaaaatgactgagtaggtatttccatgtagtggaatactactgatactcaatactcagagaagtgcatttgcatagactttgggatgtctaatttacacaaagaagagggtaagtgtgagtttaatgtttataagataatgttgagcatttacttttagcacttctaatgagctaaacaaatctcttcattcaacaactccatttgaaagataaaaaacagcatttaccttgtacaaaagtcttggagctctgccctaaatggcaaaagtcaggcaagagaattggttgtaagttttctcctaaacatttaggctgggcatttggctctttgctgggcagaggaaggggctgaactcaggataaactcaggaagggaggagaaattaaagtaaacatcgaatttgctgtcattgctcacaagaactattttaaaaatcatgaaaaactactgactttggacatgcatcgtggctgtaaagatcaatgaatttggccataatgttcaatgagtatttgacatggtttggctctgtgtccccacccaaatctcaccttgaattgtaataatccctatgtgtcaagggcagggccaggtggagataattgaatcatgggggtggtttcctccatattgttctcatggtagtaaataagtctcacaagaactgatggttttataaatgggagtttccctgcacatgctctgttgcctgcctcatgcaacatgttcctttgttcttcctttgtcttccaccatgattttgaggcctcctcagccatgtggaactgtgagtccattaaacttatttcctttaaaaattacccatttgggggacatgtctttcttagcagcgtcggaatggactaatacagtatttatagaattaatggatgaggttagggcaagaagggcgagaatgcagtaggagtataagaagcattggtttccgagattcacttgggcccaagcttatgctcccttttcctgtctgctcagagaacactgaagagcatgctctgccacaagaggaggtctttgaggacttctttgaagtcccagagggggtcctgagatccaggaatcgagcatcaagcggctctcagatttgtttatatgttttggccaatgccatacattgtatggccttaatttagggtaaaaaaaatggctgctttagaaaaaatgttttgggcatagaaaaaaagaccttgattttttaaaagagattgtttattaattattaatcaaaggcattttttcaggacattaggtcaggttctataagaagtgtgatggcttattttttttctcttagtaaggctacattctacctgagaactcaggacctgaggacatggttataggaagaaaaatcatagatgaaaaatggttaacaatagtcagtacttagcattgattcccacaatatcattatgtatatttcaattcgattacagacaaagccattaaaaatgaattcttttagttctttaatttattcttaaattagctataccattttttctttgaaatattttatgttctttttcttttaaaaaacttaagacattttatttttaattattgtggatacacaataattgtatacatttatggggtgcatgtgatattttgatacaagcatataatgtgtagtggtcaaattggggtaagtggatgatccaccacctgaggcatttatcattttttgcattagggatattccaattccactctttgttattttgaaatatataagaaattattaactacagtcaccctattgtgctaccaaacactatgttttattccttctatctaactgtatttttatacccattaaccatctcctgttttctctctctctctactactcttccaacatgattcaaaaatcaagagggacaaaaggtacacagtaaagtgtcccttctacctgtgtctcccatctactcaactcctatccttggcagcaaacatgttgtcagtttcttatttatcctcccagaggtatcttatatctattttaaaacacaatgagaatataagagaagacagctcttagtcatagccatcccggacttcttcccaacaggtacagattgcggagtcttatttgtcttatccagggatcttggggaaagggtggctaatatttgaaccctcttaggggcagattctaagaaagtacatcttccccttcttctgggatttcaggtcagaaaaacagacacagaagcagagataatggtgactctgtagttgtgggatccatagctggcactgaaaaaatatatagtatatcattataaagcttttaatttttataaattcaaatgtatgttaaatatatacatagtatcagtgtccataatatcactatctgtccctcccagaggatctccaatgttatttatggtcctaatgtcggaggacaaattatagaacagtaatgactgaaacagagccagcctgtcctcaactctccccatgccattatgtatatttcaatcctattacagacagagcaagcaagtccagaacgaaaagtaagaattgtgccaatcaatcagaattagttttacctaaatgatattatgagatgcaaaaatatggctttagacactgaaattagacactgaagctggtgtcctctgtgcagagaatgctaatgctgagattgtggtccctagtggcaacaccagctgccccactgccgacccgtgccctgacgctcttcttggaaatcagcttgtcaaatgttgggagtgctgcgatgcgtctgcacggatccatttagaactccttctcattcgcattcatcacagctggcatgaattcacaagtgatggcagcaaaatgtttctgccagtttctaatgcctcttagaaatatgggcgtttttaacaagtggttgcctgactgctaagcaaacacactgagataatttctctgaaaagagagctcattgttaaacacggacacttctggcagtattcctgctaatccatccctgttcactgtgtcactgtgccagcatcatgtggacataagaatggatgccatagctgtccattatttctgacatcatggcaatatgttgggtggaaaatagtagttatttcttcaacacgtgaagaataatcatcaatagtattattccagcaagagatttaggtgaggtggaaaaggattggcccacacttctctgcccttctctccatggcataaataatggtgtgttccagggaaattgtttgaatgccgcagggtacttctggaaacctaaacttctgaaataatgctgcataacttcagaggtgggtaagaaaaggccatgctgagattgacttgctaaagaagttacacgtgggtgttctggctaacagcccagctgacctggctgcagccacatgtaagagctaccttgagcatccagcttagttgaactttcaggccccactggcaactgactgtttccatacaaaagactccaaaccagaactgcctagctgagtctttcctgagttcctgaactacaaaatcacaggaaaaataaaatggccaccattttaatcctctgcattttggagtaacttttaaacttggcaatgatgattgaactgatgctttaaaaattaaaatgtaagtattgtagaaataaaaacattagaagaaaatctaggagactaaaaatacaatctaggaattcaggagattttaagtgagttaaaatatccagactggatttatgtagatatatacacgtatatgtatttattatatgtatatacacacatgtatgaaaacatatatgtggccaggtgcggcggctcacgcctgtaatcccagcactttgggagcccaaggtgggaagatcacgaggtcaggagttcaaaacagcctggcaaacatggtgaaaccctgtctctactaaaaatacaaaaattagctaggcgtggtggcatgggcctgtaatcccacccacttgggaggctgaagcaggagaattacttgaaccgggaacctgggaggtggagctcgcagtgagccgagatcagtgagccgagatcacgccgctggactccagcctgggctacagagtgagactccgtctcaaaaaacaaaacaaaacacaacaaaaaaccatacatacatatttaacatatatttgatatcataaaaaattaaaaactttataatgatatctattataatcagattaaaggagctatggatttggaaaaatatatactcaaaaaagccttagattaataagaaaataatgaaatagaaaattgggcaaataatatgaataagaagtttacagaaaatccaactcaaagaagcatcaaatataagggtaaaaatactcaaattcactagcagttaaaataataagacacaactttagattgcccaacaatagaaatgaagagcccctatatggttgagaatgtgaagtgggtacacttgacatagccaatggaaatatgagttggtccattctctttggatcaagatctggtgagatctattaaaattaaaaaccatatgctctttaatcaccaagcccagtattaggaaactatcccagagacaaaagctcactacgtagggacagaagtacacagatagttaatgtaactttgtctcaagacatgaagatcaagtgaatgcccattaagcaagaaatggcagaataagctatgggtataagcacaatgtgaaatcgtatgcagttataaactattaaaaaaccagtaagggcaatggcagttgactttcaggaaaccaactccaagtgtcattgctgaatgagaaaagcaaggttcgtgggtgtgtgtacaatgtgattgcattcaaagcaaaacaaagaccatgaaacaactgtgtacgtgtttgtatatgattaaatgaacatggagaaaaacacatagggagatatgacggggtgggagaggcaagcaaaaaatgtaaagtgtacactgaaaatactaagcacatacagtatgactaccttcatatagaattacgtatgtgtatgcagatgcataagtgaggagataaaatatagatctatattcacttaccaattaagagtttttgatatattcattgaaaaccagtttgagaaagacaaacaaaaatcctgaaaatgtgtataaatacttgtaaatgatttataggaaaaggaaaaactgtggctgaagaatgagctattaacattaggcccccaggatggtgaagctggagagcagtctggggaagaagattcgcttaaaaaaaaatctttgcattgctctagttactccaacaattatgcattacttctgctatttgaaaaagtaaatccaatgccaagactttgagtattgccaactttccgtagctattggtgacattgcctgttttatagcctgcctctggtgacagtaaattgaattttgatcaggtaaaaaccaaatttaagcctgctctgtgcacctgtcaattacttgcttgaaatgctttaaatcactttgcttgaaatgccccctgacttctggggtccagttatacttgtggccattggtaaagggtgactttccatccgcttttccctggctgagattgaccatggcgtcagtcctcgtgtggtctccctgagattgggagggtccttccatgtccctcagtcttagcctgggctctttgttctggctgaagttggcattcgggtcaggcacctttcaggctgacatacatattatattaatccatccatcctgcatgtggatggggagaatgcatagcaccctcattgaaaatttgctttatctccctttgctgattatgttcttatcctttttgatcttttcttcaccctcctcctttcttttgcacagcaggcaatgggatggtgactctttatatcctaatgccaaagaccctaaggtcaaccagctgctgtctactagcctccttcaagagtcctattgctaatggttagttttttataccaacttggccaggctatagtatccagttactcactcaaacactagtttaggtgttatgatgacattttatagatatgtatataatctatatactatatatctctatatatagtatatatatatacactatactatatatctatatatactatatacatctatagattatatgtgatgtggtttatatatatgtatatatgatatacatatgtatgcatatatgatatacatatatatgcatgtatgatatacatatatatgcatgtatgatatacatatatatgcatgtatgatatacatatatatgcatgtatgatatacatatatatgcatgtatgatatacatatatgagagatgccaatatcagttgactttacataagaagaccacccttgataatgtgggtgggcctgatctaatcagtggaaaggccttaagagcaaaaccgaggcttccctgaggaagaaatgtctgcctgtggaccacagagtgacttcctgctggagagtttctgacctgcccacctgccctgcagatttcagacttgcccagcctgacttcacaatcgtgtaagccacttccttgaaataagtttccatacatgtcctactgggtctctttcactgctaacatactgacaaatacatttccccttcaactcgattgacctggaaataggacctctaagtcatctctttaggaaaaaaaaataggaggaattgggtgaggtgggtaagaggcctctctagttccttctttcatcggtgagtctgctctgtaaattggttggtaagattaataatttgtgactttgaaaatattatcactcaaaaaaagacattatttaagactttaatgaaacagaaagctcccctaaccctggaagagcaaacaggaacacaggaagcgttcacagctggctctcatggaggcctgctttccaggtacctcccagacttaggtctgcatctccatctccttctcaccaagctgtgacatcttcatcagtttataaagaatcacttcacacctgtaatcacagcactttgggaggccaaggtgggtggatcatgagatcaagagatcaagaccatcctgaccaacatggtgaaaccctgtctctactaaaaaaacaaaaattagctggatgtgctggcgtgcacctgtaatcccagctactcgggaggctgaggcaggagaatcgcttgaacctgggaggtggaggttgtagtgagccaagatcacaccactgcactccagcctggtgacagagtgagactctgtctaaaaaaataaaataaaataaaaaatccatgcctctccatgcaggaacacagcctgcaggaccagtgcagagagccttggggaccccaagtcagagcccctttgagatctcattgacaatgagggctatagatgtgcctccttctccacagcatgacccgcagaaactgtcaggtcacacccctgacccttaagtgcacaatcatacctcatcccaccccgacccaagacagaaacacattttcagaggaaggaaggggatggtattttacttgcctctgtataggctctttcaccacacatacccacaccccccacccccacacacacacgtaaacacatgcattcacacacatgagtacacaggcacagatgcaaacaatgcacaaatgtgcaaactcacacacacacacacacacacacacacacacactgctattgcacatgacattgtgaggtgttggccttttcactgatgctctgctgctctcacgttcacagtgtgtcctcggatctgctggaaatcagagccagtccaatagctgcagaaaggtccaatcatttccttgtaattactgcttgtaagggtgagttaagcattcagacaatggtcatctcctgcaagtctctctctagttacagaaggcagatcttcctcctgttcagttccatcaacttaaattgtaaaagacttgctttccagagggaatgtcatgccccagtacttgttacctctagctcctgcagaggccagttcagctcattctttttctctttgatccctgaccttgtgagacggtctcccacactccaagggggaagagttactcctagcctcctggattcttctccatcacatttgccctcccccaggccatggagctggagctgcagctgcccagcctggagacccacggaggaggctgggatgcagggtgaactgtagccgagggccacctctgcctctctcctagcccacacagaacctcgctctccttccagacaaagcggccacagatggagaagtaggtggggagggctcatctttccccccacttctctctctgtatccatgcttggttcaaatgaaccagaggaatggtaataaaggcctgctctggatgccagcagtgggagtggaaagttgagaatagatgctagaaactctatgatgtaatctttttacattaaaaattttacgtagtaatgccaagaactttatatctttaatagtgtagaaaattgatgacacccatttccttgagaagagggtcaccctctggatacaaactaataccacacagagtttctggatttcattctcctcaaaatctctctgccccagtccacagtgggtgcgagtttcttgcctctctctcagctgccactcttctgctgaggcagagaagttttctcatcctctgggtctccactataaccccaacttgcatgccccaaagacacgcacacccttcccaaaaacccagcagttctctgtgagtctggtagaaagtccccattatttgtggacctactcagccttggtgagtggctggtcccaacaggatccacaagaaacttgcatgaccgcaaggcctgggcacaagacaaacccttccactgccatgctgccattatggctgttgtttttccatatggtctcacatggcctctcagcaggggacgacactgatgggatttttatgggtctgtaaataaagctctttctttcccactggagttgtaaactgagaagtagacacaagaatcagacagatggagatcaaaacgtcagctttgctgctgatcagaaggaggtggctggatgtggtttatgccttcaggttgatgggcttgcgcttatctgcttgtcccttctcccatctgatttcttgtggagcccatggaggtaaagttggtatttccaaatcagacattttgcccaaaattgctgcccctctctggttctgagtggaaagggaagaaaagaaatcaaatctcagttacttatagttttccagtagatcagcctcaccaatcatgggccatgagccaatataatctcccacagactgagacctccatcccccatggtgaggggctagtgagactggaatacgaagagagttgctcaagtggcattccctcctcatgtaattatgaggcacagggaagaagagggccctgcctttttgctccctgaatgcttaacctttagattgaagtgttaagtccctggttggccagggaggcaccatcttgctcttgcggctgctcacttggcaaaagctgcccctgccttcagccacccactccccaatatcagccactgtgtcttgagtgtcttccggggactactgccagggagtatgtattttgttctcagaagctgtcacttgggtcagaatagtaaaatattcaaattaagtttgagccacactgaagtcaaagttggaaatttattttttctttctttctttgcattcttttccaacaatattgcccaatgtagcttatctgagattctgcaatgtgattaaatgtcaacattaatatgatctgggaataaaatgccaacaacccaaagttgaatctaaacctcttcttttattaaattctcttttaataggttaggctaggttggctggctgtattctggaccctggggctctcaaatagcagcaaacaattcccagatctcatggcttaacactaggaaggtttgtttccatggacttcactggccagcctgggctctgccctgtgcctccctggtcttcactctggtgcccagctgagagcacagcagccatgtggaatgctgctggccgtgtgccagagggaaactgagcttagctaggcacacactggtgcctacagcttttcctggaagggaccatgtccctactggtcacatttcatgggccaaagaaagttacattgcaccacctgagttcaagagggcacacaagtccaatcctcccttgtgcctggaggctgagagctgaagtagcttgcaccactctaaggaccagcagagattctcagaaagaaattaaaagaggcaactaataaatatgcttggaagttaaagttcaaataattctgtgtcttcagtaaagtctaaaattaaatattcttgctcttgtgaagtcaaatccaaagtctataattcccagtcttatattaatgtccaatgaaattaaggccttcctccatttctttctctgtttattggatctctgttctctggatctgtttctctgttctctggatctcttcaacaatcagatgtgaactgggctacccttcaacatgatgtgcttaatgccttcaggacttcagaggatgcattaggttaggtcaatctctcatttcccacttgaaagagaagaaaatgatctttgcaccgccaagattctcacagcactgacattccatcaccagctaacttcattgtctagaggaactacctaatccaaacatgctctcgggacatcacactcggtaaaatcttggcccgtgttactgatgccaaatacgccatggaaactccatgggatctgagtgtaggttgatgtacagagaagaaatcatccttgtttttatctctgcaggatacctttggttgcagagcactgtgactggggcagttaactccattgcaagaactgtcccttcaccaaaccaataatggccctacttaacctgtacatattgtctccttccccagagaggtatttgttgagaaatatttgagacattgctatcttctttcaaagtatagaaatatacagaggtggcacactttcttttgcaccttgggtgtcatttcccctctagcccagtgtgtggagtcccctcaggctgctctgagagttggtcctctatagtgtcatggctgccactgaatcttacaggcatgtgtgcagtgctgtgacagagtgaactgtttctattgcctcttgttttgaaattgctaagacccgggaagcctggttccaggggacaatttccctctagtcctcatgttggttttcaatcaagaaccatccttagaacatttccaaaccaaagctgctgttattgcttcgagagtctttgctcccggagcaccactcctcacctttggctgcagcttggaatcccttgggggactttaagaatcctgagggccatactgtacccaaccaattgagtctttgggggtgtgtgatgactaattgtatgtgtcaacttggctaggccatggtgcccagatttttggccaaaagccagtctagatgttgctgtgaaataatgttttaggtgaaattaacatttcagtgaatgttgagtaaaacatattaccctccataatgtgggtggacctcatgcaatcagttgaagtctttatgagaaaaggctgagattcccccaaataagagggaattctgcctccatacaagcttcagcttgagccgcagcatcaactctgccctgaacctccagcctgtcagcctaccctgcagatttcaaacttgccagcctccagtcttgtgagccaattccttaaaataaataaatctctctgtctctatctccatcactatctctctatccctttatctctatctctgtctctgtttatctctatttctatttctatctgtctctatccccattcctatatctatctttatctctctctatccctatctccatctcgatctttgtctctgtctctacctctatctctatctacttctgtctctatctctatccctagctacctctatctctatttttatctctatctctcttgtcctatttccatctctatctctttctgttctatctctctctgtctctatctctatccctatctccctctatctctatcccttctctctctctatccctatccctgtctctctctatccctatctgtatctgtgtctgcatctctatccctgtatctattcctgtctatctctatctcgatctctattcctgtctctctatctctatccccatctctatctctgtctctatccctatctttctctatctcaatctctatcactatccctatctgtctctatccctgtctctacctacctctatctctatgtctatctcttctatctctatgtctataactagctctatccttatctctttctctatgtatctctacctctgtcttcatctctatccctatctccatctccatctctttctttatccctatctctctgtctctatctcctctatctcatctctgtccacttcctgttggttctgtttcttggagaaccctggtgaatacaggtggtgctgatcttccaggcactggtagtgtttagagctttcctggtgactacaatgtgcagcagggtggacagccccttcctgagggatctaaaaaggaccatccccctttttctctgcttcatcttttgttatttgtttgtttgacaattgtaggggttctctccatggatcgcgaccctctcctgcccctgctatttccagaaagtgcagtggcatttctgacagtagaacctcatcttaagatcattccccttctgtatcaaatgacttgctcttccatgccttgctccacaaactagcagcatcagtcttacctagagcatgacagacaagcctagatattgcacctactgagggatgatgtcctgaagtactgcatccacagctccactgttctctcagggtccatctgcagctcatcctccctttcacatctgcccaatctcatctcccttcctgcatgccctgcctcccctttgaaacatcagctttccttccactgaaatcactctccttccctccagtttaattagcctgactgcctaaaaaaaacaaacaggccagctgcagtagctcactctcataaggcgaggcaggaagatcacttgaggctaggagttcaagaccagcctgggcagcatagcaagaccctgtctctacaaaaactaaaaaattaaaaaattagcttggcatggtggtgcatgcctgttgtcccagctactcaggaggctgaggtgggaggatcacttgagcccaggagattgaggctgcaatgagtgacccatgatcctgtcactgcactccaggagcaacagggcaagaccctgtctcaaaaaaattataaaaataaacaactcttctacagctccttttcttctagtaaagtgaagtacactttcatagccttctagctcctccttgattcttctagcaaatatggcatctataaagtaatccagatgcaagacttgtcagtgcacttctaacctttgggttcacaaacactgaattaagttgtttttttgccactccactaaaaaaagacattaaaaaagtgctgccattccttcatttaattttcatggaagattcactgaaatgatctaatttctttgtctgtattttgactataaagctaatacatggctttattcttctttatttgttgatgattcaaatctactatacttctacaattaaaactggtctggaactctaaaatcgaaattcaggattacagtttatgcagctaaaaattgcaaagccaacttgagatcacacggtggtggtgattggggtaatggtggagtgatgtggtgatcatagcagtagtgggatggtggtagagatggtatgatggcagtatggtggtggcaggaagatgctcatggaggtgacagtaaccatgatggtggaaatggagcaggaggtaaaagttgtgatggaggtaggggtgggggctgtgatggtaatggtaatagtgatggtgatggtggtggtgatggttggtggtggtgatggtggtgatattggtgatggtgttgcctgtgatgctgtggtagtgatgatcatggtggtggtggtggtggtgctaatggtgatggtggtgatggaggtaatgggagtggcagcattggaggtgttgaggaggctggtggtgggaggggaatggttgtgacacagcctctggacaaggcacatagtaaggagggattcatccctcaaattcctctcaatgcctgcatacacctactggaatttgggacagtgaagcagggagtgtgggacagatgctgctctgttggcctggtcctaccgattcaaaacagaatatgaactcaccattgcctcctgaaccacacagagcccactgactattatttaggggccttgcctagaggccccactgaggtaatccagaaaggggcaagtatgttttcatcacaaatgccaagacagcaccaggctggctgctctcctggagtccaggatcaagctgcagtggctcccacggcagcaggcatgtgctgcaagccagattggaagcagttttgctaaggttcttccttattaaaacaagctctgttctgcactagctgctggctgtgagttcagagggcatgggtttatggtggtgccagtagtgcctatttgcagcggttccaagcagccatttgaccagactcccccagcaaccttttcaatctcaccaattcttgtttttcttggggttctcagctcatgtactaaaggcgtatggcaaatgccctctatacatacattccatacatgaaatgtgggagttttagggggaatttaagcaacacccctctgatgtcatttctgaggtatttgaatggagagagcagggcacgcagggatgaaaatacgagtttatccctgataagtgctggcttggaggacacaacttaggtgggcagtcagatgggctgggtgcttccttctcccccaactctcctctccccagctgtctagcccttggcacacttactccaggcttgtgtctccctaacagattcacttaccctggttgctggcatgcctggccattggaagaaagggaaatttcttcctttttttttttacattctttccctcaacaaactttattgagcacctagtaactgccaagccttgacaagacagaaaataattttgtttttctgatacttatgtttcagcggagacacaagtactctttgtttgattgccttttgctgaatgtgcccagttgaaactcactttttaacctgtgaggagagtgataaaaggacatactctttgggaggctgaggtgggtggatcacgaggtcaggagttcgagaccagcctggtcaacatagtgaaaccctgtctctactaaaaacacaaaaattactgggcttggtggcagtcgcctgtagtcccaactactcgggaggctgaggcaggagaatcccttgaacctgggaggtggaggttgcagtgagccgagatcgcgtcattgcactccagcctgggcaacaagagcaaaactccacctcaaaaaaataaataaataaaaataaaaaaagacaggctcctggagcttccttctcaggggaaggaggagcatccacttccccctagtcattcagagaggtcaaatgcagtcctctttgggaagtgactggatgtgcagagaaagtcagagggaggtctcgccgcctctcaggctgcttcgaaggatctcagtctgtggaccaatgggcttttctgcattcggctgccatggcttgtggcacattcagcaggattggtttctgacctcccatcaggctgggagcaccccaccgtgtatgtagctcaataccgagagatttgtaaaggtttttattgaatgactctaaggttctaagcctgggtaacttgggttataacagcattcataaatggaaatagagatattcgaaagacacttttttttttgagggagaaactgctgagcgcaggtttagacttcgtgagatgtttagaggacagcatattattttttgcatggctggatttaatggttgttttgcatccctttgcagggttgagatagcagaggactctcagaaaccctcacacccagcattaagaggcacacactagatcagtttgcagatacaaatctttgtggctctatactttctttaaaatcaattcccagtattttaaattcctcattattcctctatcatgtgttagacaaatatgatatccacagatctacaaatggctataactatgctgtcactgcagggatgtcttgctctctgaactgtcgtcaggaagcttataaataaatacgggacacatgaagctaatttgataccaacagcaataatataaactctgactaagggaaaattggaaagtgttgctgatctaacagcacaaagaggcattaggaacgtgcgtctgcatgtacctcactcccaggcttgggctctttcccataacatttggaggctgtgatttcacctaccaaatacctatttacatgcttagcctttggatcatataattcacatctctgagaaaatgatgtattgttacctaaatgtatcactgctaaatgagatcaactgaagagtatgttattattggcttcaaactatgagttggaaatgtccacacacttgcaccttgctttggtgctattatttgtttttgattttgttttgttttatgtttttgatgggagagtgcggggcgtgatgatcatggctcactgtagcctccacctcctgggctcaagccatcctcctgtctcagcactcttaggactgactacaagtgcacaccactgcacccagcaactgtttttttggtagttacagggtctagctatgttgcccagcctggtctcaaactcttagactcaagcaatcctcccacctgagcctcctgggtagctgggactacaggcactcaccaccacgctcgattaatttttatattatttgtagagatggggtttcaccatattgcctaggctggtctcaaattcctaggctcaagcggtctgaatgcttcagcctcccaaagtgctgggattacaggactgagacttcatgactgtccagcgctgttatttaaaatacaaactgagttctctacaaggtggaagttttaataagtgatgcaccttgtcagagtaaaagctttcagtgggggaaaatgtgctttaatttagttcatctaaatttctccacactctcagcacagcgattatcttgccttctatatcaccctgacacatactattaacctatcaaacagcagaaggctgagcaccaccaggctccaatctatacagatagttgggccaattcaggtcaaaattttattggttttggcctaaaagctgctggaaaaacttgtaaaatgaagagaagttacaatgtgattttaaagcggatttcaaagatgagaacaggataatatcagtttctggctgcaaagttttcttctgttaaaaacctataagttaaataggcacacaaatatatttctatgctctttaaactactgggtataaagtgatcacaattttaagttgcataaaaggactgcaaatattaaaacacttgactacaataaggttccttttgggccttaggtaagtaatgttttctggtgttgttccagaaagcataataaataaaataaaattatcctttgatcataccaaggggtttgtgacagtgtgtattagcctgttttcacactgctataaagaactacctgagactgggtaatttataaagaaaagaggtttaattgactcatagttctgcatggccagggaggcctcaggaaacttacaatcatggcagaaggtgaaggggaggcaaggcacgtcttacatggtgtcaggagagagagcaaggtgggggaactgtcacacacttttaaaccatcagatctcctgggaactcattcactatcatgagaacggcatgggggtaaccatccctatgacccagtcacctcccaccaggtccctccccgacacatggggattacaattcaacatgagatttgggtggggacacagagccaaaccatatcacagtgataccacaataagatatccataagtgtcagtttcttaaggcaattttccaaagtaccccacatcggatagttgaaatatctgagatgtattgtcccacagctcggaaggctggaagtcctagatgaaggtgttggcagggttggttcctttcgaggctgtgagtggggatctgctccagggtcccctccagcttctgggggttccttggcttgtagcaacatcactccaatctctgccttgtcatcacatggcctcttccctgtatgttcgtctgggcccaaatgtcccattttcataaggacaccagtcacactggattaagggcctatcctactccagtagaacctcatcttacctaagttacatcttcagtgaccctcttttcaaataaggttattttctgggcattgggactttaacaaatgaattttgggggaatctgatataaccgatcctaccccccacagtgatgcttgggcacctcagggagcacccccctctcagccctgcatcccagtccctcatcccacctcctgctcctggctttgttgtgccttgttccatctcacggcctcacccgcacaccgccattttggttgggctgtctgctttgtccctgaacgctaccttctaatcttcccttgactcctctcctgctcagagcccaggctgcctaaatcccagaccagggatcggactctgaggagcccccatttattcagtaagggagtgtctctgtccccttaataaactgttatcctgcttcttgactcatggaggaacagcaagtcctgaagaaagatgcaggaacaagggacccagaaacccagccaggtgggcttacggcatctgggaaactgtgttttggaacaagatttggggcctatttgtgagcacattgtcctaaaggcatttttgagcccaggataggtaaggaaatggaattctctgctgagatcactattaatatcttacaccacctagaaaaaaatggtgtctaaaatatccaacctgtcagacaaggagctttgattgaagatgcaatcacacagccaagccaatgccagctgacaaaaggagtttctggggtgggaaatgggtgggatgtgtccagggatttaaaacccaatccttgcaggtttaaacgaagtatgatttttgacaggaggttctcagtggagtcttgtatttttctacaatttttgattagggcctcatggactggaatctacctattctctgtctggagtcatagggtgctagtgggtaagtgtgatgttttcataggtagcagttctataaggtctcctgtacagtcatctgtggtattttcaaatgtttacctctgctctataaagaatttgggtcacttttgactatgtaagactttggtctgaattatttagactaccacccctactgcagtagtattttagaattccttctacaacttcagtggctatgacatttactaatcttggcatatgatttctgaggaagggttgcttaaaataaatacctaggcgcccagatacagaatttagctatggtgaaatctcaactgttcagtgtctcctgaaaatcagtgatatcttctggatgaccaaattgaccaaacacttgaaggctaaacttattcttccccagaacattaaaatctaagtttcacttgtatcgtattttgtttttgctggaagtgtgggctttcttttaaaatagctgacatcaatcaatcaaaccagtttcttaatagtttatcatggtccccgggcactccagttattttgtcatgtttccttgtggctccggttgtattaacagatgcaaacttgcatgtagaaggtgtgagggcacagagcatgttgcacatctgtatagagcttgctttcatgggaatctgttgatattaatttcagatcatttttcttctcatcaagatgaagtgaggcacacaaaggccacttggttgaggtcattccccagcctctctgcagacttagagaatcaagccctgagtccatcttccacggagtgtttttcttaccttcctaaaagagactcatcttctgattagcccagttacctttggtatcttggacccatctatggcttggatctactttcccatctctagttctttatgaaaggttcacgaggatttttttctcccttctacagtaatttgtgctaggagagggtacagactgactctagatcaggggttctcactgggggtgattttatcctcttccttggggatattgagcaatgtctggagacattttgattgtcatgatgagggggtgaggtgctaaccctaaccctaacccacctagggagtgagtggaggtccaggatgctgctcaacatcctacaatgcacaagacaggcccccacaacaaagcattatccagttcaaagtgtcaagagagttgcacttgagaaaccttattctaaagaaaataacactttggcaacataaactgagctacaatctctttcaacctctctttatctgtgataattcagagtattaacctctgttagcaattgcatcttaatattaaagttcctataaaatgcctccctgatggataaaccttttcatatagtttcttctctaacacacgcttcgtaaagcatgataatccataggttgaatctagtaaaggcaggaagtgaaggtaggatgccagttaaaataaatacatgcaatgttaactctgcaactggaaggagaactcagatactgtcttgcgctggttgagacaacttttttcaggtgtcaggctggtatctgcattagtttcccagggttgctgtaaacatggacacaacttgagcagcctaaaaacaatagaaaggctgggcgcagtggctcacgcctgtaatcccagcactttgggaggccggggtgggtggatcacaaggtcaagagatcgagaccatcctggccaacatggtgaaaccccgtctctactaaaaatacaaaaattagctgggcgtggtggtgcatgcctataatcccagctacttgggaggctgaggcaggagaatcgcttgaaccagggagtcagaggttgcagtgcaccgagatagtgccactgcactccagcctggtgacagagtgagactccatctcaaaaacaaaacaaaacaaaacaagcaaacaaataaaaccaatagaaatgtactctctcacacttctggaggccagaagtaaaaaattcaaggggtcatcagggccatactccctctgaatgctctagggagagtcctttcttgcctcttcagctgctggtgttgccagccatcctgggcattcatcagcttgttgttgcatcactccagcctctgcctgcgttactatttggacttcttccctgtgcatttccaaatctctctcttgtaagtcattggatttaggactcattctcatttagtctgacatcatcatactgtatctgcaaaggccatatttccaaataagttcacatttataggtactccatggagattagaacttggacatatctttctgggtgacaccattccacccacagcagtcagtagccaggatgtatgaggcactttacttccccacaccacagaagtccttttgtccctgtcaatcacgcaccgtctgtctctggcagtggcaatgttgttgctgagtcagattgctggtggcagggttgtcatttgcttgtcttcatcatgtatttcagcctcctgtgtcttttcctcctctttcttctttattttcccatcaattctccttgtctgcctgattttaccaccagaagctaatcatgatgcactttcctttatgataaagatgctcaccccattcactgagcatgggatccgactctttggatcttcttggtggtattcatttgctgcccattgcctgggagcacctggtaattgcagaagatattttcctctaagtgcttaaatgctggcagtccttaggggaatctgaggcttccataaaactggacttcagatgacaaagccatgctacattaatagctctagagatctgcagttgggatggcttatctttcagatgccatcattttggcttttaatttgtttgcgaacaatatcctttggggagctgcatccttcaacgtctgcctgcattatcacatgggcttcttccctgtgtgtctccagatctccctctcataattcatcggatttagggctcaccctaatttagtttgacctcattttgattatatctgcaaaagccatgtcttttacctgagggtaacagatagtaagaacttgtgggcatcacctaagagcagggagtgaaaaaaccaactgaggaaagaaaaatgcagggcccaaaaacctttttaaaatgtatttatttatttgagacagtcttactctgttgcccaggctggagtacaatggcatgatctcagctcactgcaacctctgcctcctgggttcaagtgattctcctgcctcagcctcccaagtagctgggattacaggtgcacaccaccacgcctggctaatttttgtattttcagtagagacagggttccatcatgttggccaggctggtcttgaactcctgacctcatgatccacccacctcagcctctcaaagtgttgggtttacaggcatgagccaccacacccagcccaggaaaccttttaattaaacaatgtagtcgaggtctgtgggaagaggcagaagggataggattgtccccaccctctgtcaatgttcaacagcctgaaacccccatcttgttgtaaccctgatgttgctgtgtcactgctcaagcagaaatacagaatgtcaataccagagcaaagatggactcttgagctgtgttctattggtggaaccaagggctttagttggagctacgaaagcggcataagtatacagaggagtctagacagtaagcctgggcaagccaggcaatgactggcagaaagacaattattattcctgccgtgtgtgcaagtgcgtgtttggaggggaaagatgaggtctgattgtcttcaggctttccaccagattagtgtttcccatgaaacctggaggttcatggacgtggtcttttgggggatggttccctgggtctttttttgcccttgtaaaatattgacaggtaagttttcaacaagaatgctgctgtcgtctatcttgtttaagattgccaccttcctctgcctctgaaatctccataccacttctgtgctttattttcctcctaaacataatcattttcaaatatactatatatctactcatgaatcttgttgattacttccttctccttaggacgtgagctccacaagggcagagggtcttgtctgttccattcactgctgtgtcttccgtaaatgagacacatggcccctgggccatcctggcttcctcatccttcaacccttcaacctgcacatacttgttattatgtggggtgtgattttactagagggaaccattcgatgttgcacatataagggatttgtaaaatgggaatagcaatagtattgagccgatgtggctgtcgtaaatgagtacctgtaaacaacagcaacaacaacaaaaaaaacccagaagcagcctgacctagaatgagtgcttggcagtgtcagcccactcaccaagaccctctgatggtgcttgctcaagccctggtgctctgctgccgaaaggaatccatatgtttgggtttccaccaagctgaaatcttaattagcataatatgtaaaatcgtgtcagtgttcagtttttgctcccttcccccgccccccgtttatatttccttaacttttggtacttggtcattgcttctctgttagggaaactactaataggagggaaaaaatgctaaaaatctttcagggaagggggaatgatcatgcttagttcaacaacttgcatttttaaagatttatgcatacatctggttttgttttctttaaaattatccttggctttataaatgcctatactcaatccaattgaatatatcaatgtttcctggtcttccataattgcatcatgaccccaaacacttagtccactcactaatttaattgtttatgtctggccatccaggcagacccatgcccttggtatgtgagcatgcttatgcataaggttagcactaacaggcgttagatgctttcagctttgctatatgttgtaaaactaatgatgatttgcagaaatgagtaggaatatacaattactttatggtcaaaaatttgaaaaaatacttgttttggctttcactgacactatgtaattggaaaaaaaaggtgatttaagaagaaaattgatttacacaaatgttttattaaggcctttgatttccatgcagaagggatattgatatattacttattttttaattgccaaatccttagtgaacattaaatgacacaaaaaaggattgtggcaaattggatctggaaacaagagttgttgctcttttaagaccaaaggttgactgagccataacttgccaaggtgattggagcaaagtagatgtttattcaattatttaactcaataaataattatgtgctagttttgttcctggcatattgtgtacacatggctgtttgccatccaagagggtatatagtacatttgggagttattatcatgtaggtcgagttggaaatgtaaagcgaatgaacatgtcttgggagataatgtagaatgaagagaagacaccactgtctttggatgggcagaccagctcacaaagaagatggaggaaatgatggaaaatgacaacaggagaaagtgtggtcttatagaccaagggaagagggagttcacaaaggaagaaacagtcagaagcatcacatgccacagtgagggtcaagtgagagtcagttgctatattgctatatttgttgctttggaataaggagggctgagtaagctataatgagttatttgggctgaagatgccaaacttgaggtcagtggttggaaaaaggaataaaactctgtgtctcatctgagtggccaaatgtgcctttgccatggcagcacctcctgctccctcacctctctgttatgcagccaaaatataattaagtgtatgattgagatatgctcttttttccttctgagcacaggatttctcaaccatggcacagttgacattcgagacccaatatttctttgtggtagggtatgccctgtgcattgtaggaggtttagctgcatccctagtctttgggggccaggaccaccaaactactgccccaaagttgtgacatccaaaaatttcttccagcagtgccaaatgtcccctgggggtcaaaactgccccaggcaagagtcattgttctagatatgtagccagggagctcaagctgcttattttgaaatgctcatcaggatagaggtgcggaacaagcagattttagatggaaactgtctcagccagaaacctggctaagaaaaggtgcgtatggtgatgaaaaccaaataaccaagtaactcagaccttaattatttaagcaaagtttatctcccctgaagcaatgaaggaattgtctctagaaggtcaacacaagactgtaaaagtcaataataaaagattgctcctagtcacatacacacaccttcataaactaaacatgaggaagcaagattggctaatggtgatggcggtttgttgtgggcatgtggttagcaggaccctccacctctctgaccataacgccctttggtcttcagtagttgatgacaataccagctcagagtcatataatttgttctctacctcatctctgccttccacagagcaaaaattcaggtggtcctagttttaaaggtagagtaatattttccccctttctcccttttgttctccacttggtttgtttttctgctttctagaatctggaggacattcctggcccttagcagacttattttccccttttcttttgcttaatctaataaggcaatagcatgtacaaaccatccagcgagaattttcctctcctacagagtgtgcggctgtgactcaggatttggtgtgtggttcacttagccagtcaacaaacaatggctgcaactctgttagcactgtgctctcacaggtgagacaggtccatgctctagacaaaacagttggctgccatttttcatttgaacaagttttgttcaacttgggggtagagataataaacaagtcaaatgtaaatttgaaagacaaaataaatacaaattataatcattggcagaaaaaaagtgaagtcctgtgatgggtttgagattatcctagattattttagtgggtccaatctaaacacacaatcccgtaaaggtagagaatcatctttcccagctgaatcagagagatgagacagaagaagagattcaaagcgtgagagtaacttgccccgcccttcatggctttgaagatgaaggaaagacgctgtgagccacagaatgtgggtgacccctggacactgggaaattatctcagctggcagccattgaggaagtgagatctcagtcctacagcttccagaagatgattctcccactaacctgaatgagcaaggaaacggactttgctttagagccttcagaagggagcacggcactgccaatgccttggctttaacccagtgagactcatgccagacttataacacatttctgttgtttaagctgcaagtttatgccaatttgttacagcagcaacaggaaactaatacactgggcttggtggctgagtggatatggaggagggggaggaccacagggtggactcctagatcagccagagggcaatgagtccacataccaaggtgagaaaactcagggagaaatggactatggagggtggaaaccagactgacgttttggtcatattaaatttgaaatgtctataagacatttaagtggagatactagcaggcaattgactatgtaagtctagggttcagaagaggagactgagctagtgatgactttctggactagaagaatacagatccaaggcaggaggatcacttgagcccaggaattcaataccagcctgggcaacatggtgagaccccatctctaccaaaataataataataataatgagaagaagaagaagaagaagaggaagaggaagaagaaggaagaagaagaaggaagaagaagaagccgtgtatagtggtgtgcacttgtagtcctcgtaattaaataccagcctgggcaacatggtgagaccccatctctaccaaaataataataataataatgagaagaagaagaagaagaggaagaggaagaagaagaaagaaaaagaaggaagaagaagaagaagccgtgtatagtggtgtgcacttgtagtccccgttccttaagaggttgaggtgggaggatcgcttgagttcaggagtttgaggctgcagtgagctgtgatcgcaccactgcactcctgggtgacagagtgagattgtccctaaaaaagaaagaaagaagacaggtgacaacatgcaacatggaactgagtggatgtaagaagtgagtgtggctggagaagcaagactaagtccaaatcaaagacaccacagtatgtgaggttgggtgggaaaggaggaggacatggcaaaggtgtcagataaggacccccagtagggcaaggagaaaaccatgagagcacagcatcagaagggccaggagccaggcatgggctgcaacggaggatgtgggcagctgagaggactagtggaagaatgacagacaggtgccacgaatttggcaatgttgaatggatgctggtccttggtaagtctgcattagtagggtggcaaggatggaagccagatgggaataggatgcggaggcaggggtgaggcgattaaattcagacaacttgttcactagaaacagaagtggagagtggatctagaatgggtgagagtgaagagatggcttttaaagatggatcaaagaacaaagctggggtgtcacattacctttcaaatttattacaaagcggtagtaaccaaaacagtatggtgctggtgcaaaaacagacacatggaccagtggagcagaatagagaacccagatataaatccacccattgcaaccaactcatcttcaacaaaggcaccaagaacttacaatggggaaaagacagtctcttccataagtggtgctgggaaaactagatatccatatacaaaagaatgaaaatagccccctatctctcatcatacacagaaatcaaatcaaaatagattatagacttgaattttagatctgaaactatgaaactactagaagaaaacactggggaaccaccccgtgacattggtctgagcaaatatttcttgtgtaagttctcaaaagcacaggcaaccagagcaaaaatagacaattggaattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcatttttaaaaatgggcaaaaaattgggacaaacatttttcaaaaagaagacatacaaatggcctacagttatattttttaaatgtttgacattgctaatcatcagataaatgcaaatcaaaaccataatgtagtatcatctcactcaagttgaaatggtttgtataaaaaagacaggcaacagcattaaggaaaaatagctaatgcatgctgggcttaatacctaggtgataggctgatagatgcagcataccaccatggcacacatttacctacgtaacaaacctgcataccctgcacatgtaccctggaactaaaaataaaaactgaaagaaaaaaaaatgaagataaaaaacaatatgcactattcaaaaaaaaaaaaaaggcaacgatggatgctggtgggaatgaagaaaggggaattctcatacgttgctggtgggaatgtaaattagtacagccactatgaagaagagtatggaggttccttaaaaaatagaaaatagaactttcttatgaccctgcaattccagtactggatatatatctataagacaggaaatcaatatattgaatagatatctacactctcatgtttatctcagcactattcacaatagccatagccaaaatatggaatcaacctaagtgtccacaacagatgaatggataaagaaaatgtggtatatatacacagtgtaacattattaggcccttaacaaaataaaacccctgtcatttgcagccacatggatggaactgggggccattatgttatgtgagataagccaggcacagaaagacaaatatcacatgttcttatctgtgggagctaaaaagtggatctcatgaagatagagaatagattggcggttaccagaggctgggcatgggaggagtacaaaggggtaaagtgggaaaaaatcattaaatgtctttaaactgtacacttaaaaatggtaaagatgggctgggcttggtggctcatgcctgtaatcccagcatattgggaggccaaggtcaggagttcgagaccagcctggccaatatgttgagaccccattctctactaaaaatacaaaaaattagctggacatggtggtcacgtgcctgtagtcccagctactcaggaggctgaggcaggggaatcacttgaacctgggaggcggaggttgcagtgagccaagatcgcaccactgcactcctgcctgggcgacagagtgatgagactctgtctcaaaaaaaaaaaaaaagaaaagaaaatgtaaagatggtaaattatatatgtatattttacctaaatttttaaaaaagatgagtcaagtttgtatactgatgtgaacgatctggtcggggaggataagtggacctggagagagagagagagagagagagaggaacagagagatagagagaaggggagagagagagaggagaaatgagaaagacagagagagatagaaagagagagagaaggaagagagagaagaggaatgagacagagagatagagagaagggagagagagaggaggaatgagagagagaaaggagagagagagaggaggaatgacagagacagagaagggagagcgagagagacagctaagggggaatgggggaatgaaaggacagaggagagacagaaataatatttggggagagaatatttggggagaatataggagatggaccccaaggcacacgcggaggaatcagcccatggcgttcactgtagtaggaagggaagctggggagatggatctgtagatttgtcagtgggaggcggatggaaaagaataaaaattcctggcagcacgccagctcggccttcccacattagtacggccgtaataacgacttgggagtaataatccaaaaattcggatgtggagagggagatgacactgcatcactttgatccaaatggcatttttatgatggctttaaatatgtttatgatgtttacaaggagaaagtctagaatgctgagcaaaaggatgcctttgggaaaggacattaacattttgctgacaacaataacccccatgcttgcctctctcctcccccaggccttgcactccttctagttcttttgttgttccacacctgcaaggttgaccagctgccccacatcaggggactcagctcttgaaggtgttatcccaggaatggtagtaggtctttctgagtcaaatcaatgtcctccaatttgacttccaagtgaacttgtaagcagagatactcattattcagctgatagtgttaacagagatggctcagattctagaattattcctgagacaggctaactggaccatctgcaatgattcatatcatgcgtggtcttcaggagtccacaaggagaaagaaaatatttaaacttttatgctagtaacttttatctcattcttttaaaactgtatgttgcagtatataaaagcattaatacaataatatatgcatacaatttatgtctgtatacaatcatacagtggtgtgatcaaaacctttatcctgaaggaagaatgtggtctcacaagcctacacacacacacacacacacacacacacacacactcacacacacgaccatgcatggcggttgtgagatagtaacgcaatggattttcattgacattcctattggtggttgtcctttcaagagtctctcctggtgggtttggatcgtaaagcacttgctgcagcttctgagctgtcacgtggtgctggcttctgaaggaaacgtttgcacctctgcataatgtttgagctaaaatgatgaccctacgatagtcatactatatattaattggcatatagaatgttatatatgcctgcagtgcacctttctgcagtgactaatgggcctagagaggtggcctctctgcaggagctgctcaaggcaggtgagcatggctatgttcctcaggaggacatcacctatttatagggccctgcattctttctggtcctcagcaaggccatttgtgaattgaggcaatcaatatcccacccacccgaaccccatgatttcttagtggaaatagccaatatccattctgagtttactcagtgccaggtgctactctgcattagtgctctaatgcagagaaacttatggtaaagataaggaaacagaagcccatgtggtcaggatttgctcatagctacggagtggcagaccgaaatttggtttcatctagtctgtctccaaagcccgcagtctgaaccatggtgatttttgcctcttgcactctcagctgcttgcagctgcaggcacaatgattccagatttacaaaggcccgcaagtttagacatccacatttacataatgacttaaggatttgcagatgtctgggaaaaattatcctgctcacttggattattgggactgtgtctcaactttccattttattttgcacgtgtgcacaatattttcaggtaatttctatgaaataatatcctgtcacatagttaaaggttataaacatggtgctttacctttgtttttgccttaatggccaaaggaaggaggttagcgagtgagcacatttgctccttttatctgcagtaggagcgttttgttggaagtatttccatgtagcagcatgaagccaaataagacatttacaaacagttttttttttaagttaagatatatgtttcatctcttgtttcacattgttgcactcaatatttgcaattgagttagcttaaagtaaagtgcatttattcgactagatggtttgctccagttgccccactgtgtttttttcttctatttgattgctgtcttggtactaagccagtacaaagacaggaatgaagatttacaaagttttcaaagattataatgggcccttgggtgtgatattttaaataggagctgactttaagtcaaaagctttcaaatcaaccagtaagtacttaacagaagtcctttcttcatgacaaggatgaaacacagagtggattacgcaaggtgaatctggtcagcccgggcctgaggtcacgtctgactcccagcaatggtgttttgcttggagacttctactgccctcttggcccctctgtttgacctggcatggtccatctgtagtcactctcataacatgtcatacattcctacacattctcattttctgtgctccttcaactttttttttttttttgagacagagtcttgctctgtcgcccaggctggaatgcagtggtatgatctcggctcactgcaatctccgcctcccgggttcaagcaattctcctgactcagcttcctgagtagctgggactacaggtgcatgccaccaagccgggctaattcttgtatttttagtagagatggggtttcaccattttggccagcctggtctcgaactcctgacctcgtgatccacccgccttggcctcccaaagtgctgggattacaggcgtgagccactgcacctggcctcaacttttattaaaaaacaaacaacaaaaaactgaggcagggccctgcctggtacccctgacagccttcggaagaagaaaacaggccttctctgtgggtcatgtctccagggtgtgcaggaccaaatactgctttattcataaaacaggtagctggaaagctgccccactgagactaaagggaatggggtaaatcatcctcccttcatttggctgtggcttctgacaatctagatagttgtttgcatacctgtgtgcacacctgttgtcattctgtttggacagatgactagcgtacaatacaggttcttcagaggatacgtaattaatcaaatcataacaacctcaataatataatctgaagaattaaaagcagggctctggtatttgttctacatagcattcatataaatgtccgattgctctttgcagcttacgcttggtagtcccaatcactctctagaaagggcttatgagcagctacctggaaggcctggattagggagtggtagcagatgtcatggttgagaggatctaggggaccaggcagataccccatcggacagtgggcatcctctaaactgtctctcactgacttcactatgaaccacagtaccataattttggtctttaccattttcaaaattttctgtttttcaaaccacaggttcaaactctatcgtagtttcagattagtagtccatgtttttcttatgactccacttatttaagaacttcagtgacatacatttatctccacgtagtgaggataaaaaagttgagaacaagaagctaatacgatcatcaagacacagtcacaggaagtaaaataggaaggaaggaaaaagaaaggtctaggtcttcagagacaagggagagatatggcaaggcagaagtccctaagagttcaatataaagacaggtaataccaccactcttaaggaaaatattcccagggattcaaagttgatcggttccatgtgtctaaaattcacttggacttgtaagagaaccccaactttaatggaagaagaaaacaggtaaaaatatcctcagctcagggttagtggcttttcttatctcaaataaagggaataactcattcatgttgctgggctttctttgtcctgttttaagaaatttcaagttgttggctacccaaaagctgcattctagacttcttcctcttgtcccactgggtagaagcatggcctgatattttccttcttcagtataataatttcattttaaggacagtcaggtcctctaaatgtgttattattttggttcaggctttaaaccgaataagccagccaaacattgataaaagcaatgtatctgagcttcccatatttactcggcacccagtgacatttggctcttatctactgagaatatgagagtgataacagtaggaaacttaagtcagagcctgcaggttcttatttaatatctatagacactaaaggatttgcatctggatttaaaaggaattactctgagaatatttaattccaatagttggaggaaattgctcctgtgatcagtacaatttgccacagttttaaacatgtgggtgacaatgactgactttcatatttctgtcctcggcagcgtgactgtacacaactgagtcgcagccactctcagaggggattgcagcctgcagctcacgtcttagagcttctgaatgcagcagagaaccaacttgctgagccactatcattattaacaaaacgttggggattttaaaagaatcctcagagagtcccagcaacatattcaatatggaatgataagggccaggcctttggagagttgaagaaaccattttcccagtaaacccttacatcaaatgtaccagtgacatctgattgcgctgtttcctctcttggaaatgctcttcccctcctcctcacctatagaaatttgattcacttgtcacaactgaactcgaatcctgcctcccccaccgagccaccctctctgaggtttccttccctgactccagttggaacgagtcctttcctacttaaggctattatgatatgaccctttgtccctaacacactgtacttccaaagcacacacgggtttacatgcccgtcctctactgcatgccagactgtcactcactgtccttagtgggggcgaggttctgcattagcaggaaccagaacagcaccttgcatgtccttaagcggccgggttttggggagctgaatctgttcatgcacacttggccttgtcctgttctcaaagctgctccacagacacggggctgtctcctctccgtggatgtccctggctggggcagcttcttttccatgcatcagcctgtagcacgatgtgcagtcttatgagcagtaagaataaatgtaatgtttcttacccagcaaccgcagaatgtgcacagctgcaagcagagtgtgtgcatgtgacagtgtatttgtgtaattgtatgtgtgtatgagagagagacactgtgcatatgtgtatcagatgtaactatctatgtcacgtaaccacatattagacttaaatgttactgtttcaagtttttaatattaaaaagtagattttgaggtcaggcgcggtgtctcacgcctgtaatcccagcactttgggaggccgaggcaggtggattgcctgaggtcaggagatcgagaacagctggccaacatgatgaaaccctgtctctactaaaaatacaaaaaaaattagtcggacatggtggtggatgtctgtagtcccagctactcgggaggctgaggcaagagaatcacttgaacccgggcagcggaggttggcagtaagctgaggtcgcacctctgcactccagcctgggtgacagggcgagactccatgtctataaaaagaaattgattttgattttccttttgtgcttgtcctctgatgtcaccttcctccccacaacacacactactgttgttaatttgttcagaccatgggttcctgactcacaattagaaagtggaagtgacagtagaaacacattgctttcactctgagcgcccatggtgggctgttccctattttcaggaggtagatgttcatgcgggaatactgctttgaggactacatgccttgagttcagaaaataagtttgatttaacgcgccccccgcccacccaccgccttttgttttgcagagaacgaagactcagtcatatcttaggatgtcttaggcctgaacctgaaaaaggcttccctgctttatgtcatcatcagtcaggatgctatctccctttatcttttgtcccgtgtgctgggaggacatggtccagggtgaaatgaaaaacaaagtgaaatgcataactttatttgcgtgtttctaatcatcctttaacagcaagaataatacactgtattataatagtcaaatttactctcttgagcttacttcatctggagaggtctactgactattttggtaactcttgtaagatttttcactagctcaagcagcatctctcaaagtgtcaactgttcacctttcactccagttcatgctgctttttctggctgtgctgctaggctgaatgcatcgctaacacccgcacaggggacacagcagattttagcagatgcctctgtggtttgcaatgggagggagcacttcccatgtgtcccaaatgaaaacaagcagaacttcaggtatgaatatatatgcaagtacatacaattagaagaatatgcagatgtacacatgcctcctgggcacctgttttcaggacagaaaaggaaagagtcagatcgtgtgtctctgcatgagctcaattgagaaaggggttccctcaccaaatattcaactcattgattgttgcaaattctgagctggatgctaatgaggaaatcaaacactggctccttcatcccagatttgtaaagcttattactgatagttttcagtctttccgtcttctaatttataacccaacttctaatgttcaagtcactctgctctgtgcaagaatctacccctccatggttgggagactttggcaaacccaatcagagatgaggacaaactgaatcagcaaaggaggtggtgctgaccaggttctgacccagcagcatgtcttgggaagaaactaagcccttcctcaatacctccccgccaagctggcactgctcattgactcagatcacaaatcctgggtaatctgggtggagcatgttgcccaacctcagtgacatttgctatttctatttttggaatagagcgaaaggatccaggagatcaattcggcttgatcctgttttttcctttctagtcaacctcctacagtgtgagcaatgaccctcactccacccccaggcatacacacccccctctacatcccacaacttaggcagtttctaagactttgggaaaatccctgggagttcctcataacacaaaatgccttgggctgtacaagcctaggagaagatgccaagctgtggtctaggctcagggaatagtttcgctgccccttcctccccacctccctacagacaccccccaccagccaagcagcctgttcccactgatgcctgactggggaaggagactgagtttgttagggccaaggccataagcacttatcactcagcaaccacaaaagcaactgggttttgtgttgatccctctaagattaggccttgaacctcctttgtgcaccccttcccaacagacaattgtacttctgtctgaaagttttaattaaatgactcctgcacaagctgtctgatttcaggagacatagcagcatctattggatcaacagttccattgtttgaaacatgaggactataaataggaggcagaaactgacagcacatttagtgtgtttgcctatgtggtaatggacatgaatagtatgggcactgagctggtgaacaacagaatctcaaaaagggaagaacacatttgcccaaaacattaatcagtatcaggctggcaggagagaatcaaagtagcttctgtggagagaagacacctcacccagagataaatagcttgcaagtattagaacattcacagtgaaaattaacccatttcctttaaaaaaaaaaaaaacttttaattttgagatacttttagacttacagtaaagttgcaaaaatagtacagagttccgtatccccctaatccagcttatcctaatgttagcatctaacaaaaccatacaaccaagatgacgactaagaaattaacattgatacaatgctactaactaaactgcagactttattcagttttctccagtgtttctgccacggtcctttttctgatccagagccaatccaggatatcaccctgtatttaattgtcacatctacttggtttggtccacatttttattactggttgtattttctgcacttttttgttctttgagacagagttttgccccttttgcccaggctggagtgcaacggtgcgatctcagctcactgcaagctctgcctcccaggttcaagcgattctcctgcctcagcctcccaagtagctgggattacaggtgtgcaccaccacgcccaggtaattctgtatttttagtagatatggggttttgccatgtgggccaggctggtcttgaactcctgacctcaggtgatccgcccttctcggcctcccaaactcctgggattacaggcgtgagccatcctgcctggccattttctgcattctttctacacttattaattgctgtttctctagaaggaagtgttattccttctcccccatttatttattggttttttccaaggagacatgacaattaaaaacagggtgatatcctggattggatctgtgacagctccttggtgttccctttactttcatgaccttcttacttttaaagagcattggtcggttatttcatagaacgtccttcagttttggtgtgtcttatgttttctcacgatgagattgagcttgtacattttggggttgaataacagaggtgatgggcccttctcagggcatcaggtcagagagtacgtgatgactatctgttttactattggtggtgttaacctcaatttttaggctaaggtggatggagttaacctcgattactaggctagggtggtgtgtgcctgtcaaaattatccactggaaagttcctatttttctttttgtgattaatagacatttatgttgaagggggtcctttgaggctataaaaataacttctttttttttaaattttgctcactaattttggtatccatgtgtagatcttgactggagaaatttttgttactggttgtattttccacattctttctacatttattaattgcaatttctctagaaggaagtgttattccttctcccccatctatttatttattcagttacttatttatatcagtatgaactcagcattatttattttattctttggataagaatgcaataatgcaatactataacaatttattttcctgatcaaattgtttcagctttggccgctgggagctcttacaggctggctcgtgccccctattgcaagcttctatttcttttgtttgactgcttctttactctctggtaccacaaatcctctatgctcgtcttatatattctttgctccagctttggaattaaccaatacttcaaaagtcctgtttccttttattgcaaagtcaaatttagaaccaagatctgggcaatagatgtgctcattgctactagaatgtcatttccactaggtcatctcagcagacagaactaggaaatgcatgtcatatgtaccaacccatatgtatatatgtatctatgtttatttctgcatatatttatctgtttatatattttaagtaaacacaagtttgtattgatactttggactccaattcagcaccacatggttcactctagccttcttccttatttgtaatgcctttccctgactgtgagagcctgactcacagcatctaccatacatttcttgttttgctaactcataacccagagacaaacaaatttaccaaataaaatacagcatggagtatagttcttgttgtctttagccttccagtatcgagtcaaaacagggtttccaaagatacctaggtcagctcttttgtcccccacctgtctcagtgagccttggtgattgattaatttctgacacagttgggtttctttcttactgtctgtgtttcttctcaactgcccccccttccattcagccaacatgctggttgattttaaaaatttaacttacatataacaaaattgtaattctgtacatcaaatttgtatgtcactctttgtgacatatagttttatgcattttgacaaagtgatagtcatctatttactgctatagtttcttagagcacaattccattcccactcccctaatttcctcatgatccctgcttgtagtttgtcctccccaccatcactcaactcatggcaaccactgatctgttttccatcttataaagatggaagctgtaagcttcacctcttccagaatgttgtataaatagaatcaaacaatatgcagcctttgggatgaacttctttcacatactgaaaagaatttaagattaatccatgttgttgtttaaattaacaatttgtttctatttattcctcagtagtattccatgatacaggtgtaccatagtttatccatccttgtttgaaggtcacatgggttgtgtccagcttttggccactatgaataaagattctatatagatccacatacaggtctttatgtgaacatatattttccttttcttgggtaaataactaggattgggattgctgagtcatatggtaggtgcaagttgaacactataagaaaatgctcaactgtttatcaatgtggttggccatttttgctttgagcgaatagcaacatatgagagttccatttgctctgcctccttgctggcatatagtattatcaagatttatggggcttagccattctaataggcaggcagtggtattaccttgtggtgttatttacatttcccaaatgactgatgatgttaatcatttttcatatgcttatgcaccatctttatttacatgcctgtttagattacttgcctatttaaaaaatattgggttgttcattttcttatttttgagttttgagagttctttattgtattctggacacatgtcctttgttagaaatgtgatttgcaaatatcttctcccagtttgtggattgtctttctaattttttaagcgtgtccttttcagagaaaacatttttaacttttataaagtccaactctttctttcttccttttctttccttttttttctttttcttttccttgagatagagtctcactctgtcacccaggctggagtgcaatggtatgatcttggctcactacaatctctacctcctgggttcaagcaattctcctaccttagtctcctgagtagctgggattacaggcacccaccaccatgcccagctaatttttgtacttttagtagacacggggtttcaccatgttggccagtccggtcttgaactcctgaccttaagtggtctgcctgcctcagcctcccaaagtgctgggattacaggcatgagccactgtgcctggccattattttttcttttataaattgtgctttggtattatatttaaatactttttgtctaaccaaaggtcattacaatttgcttccatgttctcttctataagttttatagttctacaatttaaataagtctattatcaactttgagttactttttttgtataaaatatgaagcatagtttaatattctttttaaaaatataaatgaaatattcacatgaatatgaaattttttcataattccagcaccatttgttgaaaatactattctctctacattgaattaattttgtacctttgtccaaaattaattggctattcttacgtggatctatttctgggttctcatttctgtttcattgatatgtatgtctggccttttaaaaatattatattatcttaattattgtagagtcatcataagtcttgaaatttggtgctatgagtcttccaacatttttcttctttttcaaaattgttttggttattctagatactgtgcttttccatatatatttagaatgagtttttcagtagctaccaaaaaagctttcttggattttgattgggattgcattgaacctatagatcaaattaaggagaactgacatcttaacaatattaagtattctaattttgaccatggcatatctttccatttagttagatcttgtttgatttatcagaatttttatagttgtcagcatgcagattctacacactaaacaaaaaaaaagatttatacctaagtatttcactttaggagccactgtaaatttattttaaaaaaattggtttccagtggttcgtttctagtgtatataaattaatatttgtatgttgaccttgtgtcctgtgacttggatcaacttgcttaccaaatctagaagctttcttttattccctagtttcttttttagatttttgtatgtagagaataatatctgtagagaataatatctataactagagacagttttatttcttcttttctagtctgtatgcttttttttttttttctgccatattgcacagactaggaacccagaacaatgctggataccaggagtgagagaacctccttgacttgttgaagatcttaggggaaaagatggaaagtctttcactaataggtataattataattaattatttcaatatcctttattggttaaaggcaggttcctaggtgatcacaagttttttttttcacgaatagatcttgacttttgtcaaatgctttttctgttatctattgaatatatacatttttttttcctttttagtctgttaatatgttaattacactggctgctttttgaatgttaaatcagtctggtagtttttggaataaactccacttggacatgatgtattatatttttaatatatcgtttgctgaaaaaaaatattggtagaatgcatttattgttggcagtaaagacctccatgttctttaaaagccaaagaccagggccagagtactgctggaagctaatctcctccctgggagccacacagataaggttaactggaagcaaagggctctggaagagaggaagccagggtgccgctgctgcgccccgttcctgcctggcttggacgtatctggaactgacctcattctttcactatggtggacagaattctaaagctgtctttctaagatgtcgtcccctggttatataatcaagcgctaatccaggtaatgctgtgaagggactttgcaacccaaattaaggaggctaatcacctgacctgaaaatatggcaattatcttgggttactgagtaggtccaatgtaatcacattagctcttaaaagcagaagaggaagccagagagatgcagcagaagggctggtgggactggaaacatgagaactttgtctgccattgctagttttgaagatgaagatggaggaagggaccaccgaggaatgtgggtgggctttagaagccgagaacgatgcccgcaaggaagcaagcaagggaatgcacccggaacgactttggaagcagatttattccccaaacctccaggaaggaacacagccccactaataccttgattttggcctatgagacccagagcagagaacaagctgaaccccactatgtgtggacttctaacctacaaaactgtgagataatagatagacactgttttaagatgctaaatttgtggcaatttgttaaggcagcaataaaaaacgaatgctttggcttagcaaacatatacggaagaccttctatgtgtcagggactgccaggtgctgaagataaggagactgggaagaaaaacgacctctttatctaaggggcgcaccaaccagagggagactataacaccaaacaaaacatggaggtattccgtatatgtgccgtaaaagcaaagcttatcttggttgcaaagaataaaaagcaattctggctaactttaaataacaaaagaaaaaaaaagagagactatgtgcttttaattttgagagcaaagatactggaagattctagtttgaatcttctagtttgaaggaaacttcaaacatgtcagatttggggaaaggacgaccagtacattcccaggaaccttagtcatagaagtttgtagactttctgctggttctttaactctgaacccacagttcttggccttaatttatcctttccaaatttaaaattataagagggaaaaagacaaggcttagattggtcctcttcaaggacggcatcaatctattcatgaaggatccaaccctccccagcccaaacacctcccattaggccccaccttaaagactagtaatcaaatttcgacatgaggtttagaggggataaatatccaaactatagcaagggtaacctgttttacttagagtccattaaaaaaacatcttcacagcaacatgcagcctggtgtttgatcaaatttctgggtaatgtggactaggcaagttgacccataaaattgaacatcacatcttgtggtacacataacccatggggtctagctctatgggtcagagcctcatccccagaaagaagcctctttatgggccttaaagttagtcaaacaggtgctcccaagactgtccagttgtcagccacacttcaattacccctacaatgaggatggtaatactcataggattttttttgtgtagcttggaaaaagattatgaggataaaatgattttgttaactgttaagtgatgtgcgtatgtgaagttggcattatgtattttaaattaagattcaaggaaagttggcaaactttgaaatctagaatttgtacttgctactaaaaacgagtaatttttaagtgagacgtcaggaaaccccaaagccttttcgtgattccaaatgctgtcagaaactcctcaaagcaaaactccaccatctgcactttaaattgaaaagtgtggcgagtcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatataccccatggaatactatgcagccataaaaaatgatgagttcatgtcctttgtagtgacatggatgaaattggaaatcatccttctcagtaaactatcgcaagaacaaaaaaccaaacaccacatattctcactcataggtgggaattgaacaatgagaacacatggacacaggaaggggaacatcacactctgggggctgttgtggggtcaggggagaggggagggatagcattaggagatacaccaaatgttaaatgatgagttaatgggtgcagcacaccagcatggcacatgtatacatatgtaactaacctgcacattgtgcacatgtaccctaaaacttaaagcataataaaataaaataaaataaaaagtcatgaagatattaaaaattttttttaataaaagcacgatccatataaggaaaaaaaaaaaaaaaagaaaagtgaaactgcgatcatccctgtctatcaggaacagccaggggctgatgaattgcaacaggatagggttgtcccaaccccaaatgacaaagactcactgccctgaaggataaaagtgggaaaaaacctaaacaaaaatcacgagttgagccagagatgtttgtgacccaacagaacatggatttttcacgttctcttgtgcttttctggtctttactggatgaaacatcagagcatctatgctgattgtattctgacaaaactatcagaggccagagtgagtcttacaaattttgtgtatcttattgcttcacagtcagtcccttctttatagcatggctgagtgctgaacttagccccaactttttaaaaattaaaattggtcaatattgcaaccctttcctagcccttctgtcttctgtccctccctcccttctatccttcttgcagatgtaattcaggcagaattctgacattcatgtatcaaacttgctgttgccggcatcattttgcttagtgttcattatcatttctgaacggttctatcaggcaaaggcgtcctcgttctccaagcaaggaagccccagccagacagttgtcaaggcaacggaaaatgcacactgtgaactaccaagaaaaggccgtttctggctgctaagagtttttgcactcttgaggctcaaacttaatttctgggcttggcaaaaagaagtattttatggctaattataaaatgtacccaatgttattagactaggggatagatgattgcctgctaaatgtgttgtgaaaaattaaagcagttttcagagcggagggagctaaactcagtgtgcccaaaggatcgatcgcttatttttgtcattctttatagctggaatacaacagttgatttgagtctcattatctattttgttgtcttaggtgttcaaaacaaggtagaaagtgcaccgtccatatttagactttttttggttggcgggggtgatggttagggcagcgtttaaataacatgtttcttggtccacattaagagccgtacattacacttagcaggtgagactataagatcagagtctgtgggctaatttcgtacattagctgctatcattgtcttccacatctatttatttatttatttttgtcttctattctcttcccatgtacttgcttgtcaacaaaccccaaataaatgccacatattaagttaataaaagacatggtagttagggattgaaagtgtcagggtgaaaacactggtatgacaatccgccttcttaataaggttgttcttttgtaaacaatgttttaaaatctaactttatatgaatggttgattcaaagcctggtggccagtgttacagtgaatctccattcaccgtaatggagattcactgtaatggactcagttaatccagtcgttgaataatccatgttaagccttcactttttttctttttgggtgagcctccactcattgaaaacaaggtaaacttagactgaggttgacatgattgggtatctttcctcaggatctcccccttaagaaaggaaaactgaaccatcctttagaagaggaaatatgatttacctgaggaagaggtaatatatttctttctacactcagctgattgatcatggaataaaacagtatttgtagtcctctctcaggtagagaaggctcatgaagttgatctcctaaaagaaaacaatgctatggaaactaagtatgttttaatgtttaatgtgcatcgtatttactcataggtattcaaacaacatccctccctttagcctgaaatgttcccaggattgtattttatacactaggcacattgatataggcaaaggaatggggaaggtaattatccagcaatcagacatgtcaaccaggcttgtttggataactgacagcggtgaatcaggttcatcgcctctattgctttgtgggactttgtttctctttatagcatttccacatgtgttgaaacagggcctaaatgtaggtgttcaggatattaaaactagagctttctaaaaggactgagtataattaactcttgacttaagttccttctttaaatttcatttctatctgtggtttagaggcagtgggaggctgtgaaatggaaaaatggaccaaaataagaaactgaagtgaaatgaaatgactgaaatctgtttccccatagccagctttctggagcgtttcagcagcgccagtcatccttgcatacactgagtttctactacattccaggtgttgtaaaattttctttgagtggggtagaaagtaggagaataaaaatcaaagtgacgcctggtccagctctcaaaaacctcagattctaatcaaatgcagattcggtctgaatgtgcatcatcagaatgtaccaagggcccctatcaacgtgtatacagtttccacaggaacacagaggagagagcagctatctctgcctggaggagttgggaaggttccactgaagaggtggatcttgaagaatgggtatgagttcaacatatagagaaatgggatatgagactgaaagagcattcccaacaatgcacatgtggctgagaggaagagctcgatgcatacgagcagtagagagttttttcacaaggcaggggactcaggccacttgtatggatggaaaggaagggacttaagaaaggtttttaaggcaggaagagctggctgtctccccgagacgcttctgataagctgtgctaaagagcttggcatttagctcctgggttacagggcctctgaaaggttttaagcaaatgactaccctgaagagactctggtgggtggaaagacaaagcatggattggagtgagaattaaaggtggagacaggctcagggattaagggatggttcaagggagatacacggacctgaacaaaggtagggggcatggggatggagatgaaaggaaaccatcagaaaagaaggggccaaagagggaggttatcttggcagaagaaagacattattcatcttggttggttggaaatgtgggtctggagctcataagacagatcatggatagggatatagctcagggtctggggtcctgactccccctaagggtcttacctcagagagtgatgactgagcttctggaggtcttgaatttcctgaaatttatgtaaaatggaaggtgcatgtgtatacatttcctagggaataagtcaatagccttcatcagtttctcaaatggttggaaaatggaatatagaacagcaccaaaaaacactatcttaaatgaggatctatctacagggtgttaaacggaagtgagagtaacccagtgagcaatggagaggagagaaggtcccggcagccttgaggccccttcccccttaagctgagcactcagtgtcactcttctcagctccatctgactgtccccatctctaatctctccccatatgtacttcatatgaatcaaaggaaataacatagagagcttgtaaactctgaaatgctctgcaagtgtttagttatcatttaaaagatgaaatgaaatatggcaactccatttaagcttttattagttctgcccatctccatggaaaatatctgtgacattcaaaatgcctgttgatgctacattcactaatctttttattaataagtgagcatgtaaagttcacacacctcagacactaagatatgctatcagtacacatcgatgccttcctcctaattcagggctgggtaggatgggcctgagacaacacagatggatggccaatgactcagaggtggaaagtggaatgcaacccagcagtactgtgcagcgatgcagtcagatagaaacaacatctaacttttcagtgcagcttaaatgatgttgaattagccatggtgtggcggcacgattatgtctcaacatcactgtgctaaatctaaaccagaaggaagccctgtgtgcagagagcgatggtagcaaaaagctctattaagatttgtttcagaacagaaaagagtcaatatatactataaattaaaaaaaaaattgtcaccattgtagccgatgtgagaaattttggcatgctatttatagcccagattcccatttgaagtaaaatgcagtcagattgcaagaacagggttttgagccatagaattgatcatagagctgatggagccacatatcaagaattgttgatgggagtgggttctctgcatttagacttctgagatgagggataaggaagaaccctctaatccaggtgtctaaaatagccatgggtcatttaagaaaattatccaccaaagattccttaacaaatttttttctaaaggcgggtttaggcacatggtaggaaggaaaatcaaaaagaatccctttcttaaatgagttattaaagaaatagatttgattagaaatgaactcatgaaattaaaatgttaggatgattgaaagtagaacatcacttttttcttgtgaaggtcaaatgaggggtgtgcttgtgagaaaggaaaaagacaacagcaaggaaagcaaattaaaaccaacatcaggttgtgcaatggactaaatgtgttcccttaaaattcatatattggaatcttaacaccaatgtgatgggaataggaggtggggcctttaggaagagattaggtcatgagagggggccctcataaattagattagtgcctttttaaaagggacccccgagagctctctctcaccctgtctccccactgtgaggacacaaatagaaggcagctgtctgcaaacttggaagggagtcctcaccagaacccaaccctgctggctccctgatcttggacacatgcctgttgtttataagccaccatctctatgacactttgctatggcagcctgacctgactaaggcaagctgggagttagaactctcaaattctccgaatctcagccctgacattcaatagctgtgggtggcatgatgggcatggcactttacagatttgtttcctgacttttaatctaaacaagaaagagcacaaccactactgcctacctgagatcattgcacacaagtgttttataaactgttatataaataatttattttggcacaatcttgaaattttaaatgtctatatgaaaattttctctgcttgtcaccactacctcctgtccttatagaaacgtattttcatgagccatttggttcagagtttaaaagcagggagaataattattcaaccataattgatgtcaagcaatgttgtaaaatctcttaacttatcagagtctaagcactgttggttatgaaacccaaataataacaatgcatgtgaaagtgttttgtaaactttaatgctcaatgcaaatgtcatttatttatttcagtttctctcttactaaagtctgtttttctgatctttttgctgctggtatatttttgccctagtaagttcaaaaaaattaaaaagtcgtaattcttggcttcagatacctccctaggaattctgagagttttttttctatatagatctgcattgcctgcttgattccagcacatctcaactgggtagctcctacgccaaccatttatttcatgagcttgcatctcactctcttctcaccttctccattaacctttaccttggaaacgtcagatctgctcccatctaagccaaaaacactatccaattttatatccattaggtaatgccttgtgattcaaactacatctcaagattctccttgttgagaaagcttatctcaatgtgcttggaggggtgacaaggatgcaattcgttaatcattgtaactcttcatatttagagaatgcagcaattaaaaggtgcttcctcataaacatgtgaccttgtttgatcttcacttctataaagaaaaacatagtacctataattatttaacattattccatccattgtgcaaagtgagaaaaccaacaatgtttaaatccaataaagtccaaaatctctcagatgataagtaaaacagtgaagtttgcattttttctgtctacatctaagttttttttctttcaggattttttctttgtttttggttttctgaagtttgaatatgatatgcctacatgtgtattttgtttgtttgtcacttatcctgtttggtgtactctgtggcttggtgttttgcattacttttggaaagttctcagtcattgtttctttacatatttcttctgctccatcctatgtttcttctcctactagtattctaattacatatatattgcatcttttgaaattgtcccacagttcttaattgttctgttctgcttttatcattcttttttctctttgaatttcagtttggaaagttttcattgatctatcttcaagctcactgattctttctttggctgtgtctaatccactaatgagcctatcagaggcattcttcatttctgttagtgtttttcatttctagcatttccttttgatacttttctagagtttccatctctctacttcattatccacctgttctttcatgtctattttttccattaattaccttaatatattaatcagttactttaaattccataataattacaacatatgtttcatatctgagtctagttcttaatattgttttgtctcttcagaatgtttttttcttgtcatttgacatgtcttataattttttgttgaaagtcagatacaatgtatcgagtactaggaagtgaagtaaataggcatttagtataagaattaatggtcgtctggcagagaagttcgtttgtctttagtgtttgctatagttgtatgttacaaatataaatatagccagaggtttcagatttctctagtgtctttttctttgtctcatctcttacctttgggcttccctaagtactccttcttagagagagtttgtgtcacctctttcagctgtgctgtattcccgctgatgtgatggtaaggtgcaggggaggagaagcattctctaattttattaataaatctcagtcttttaatggggctgtgtcttggggctataaccgttacaagctttctcctttggtaccgtcccttccccctgcctcctactccctttcctgtctgcagcctccccaacccatttcctggaagccatggtccttgttgactatggggatcttttgccccctataaagtagacagaaagtttggggggtgctttccactggaatatgactctggcaaagtattttctcttggagcataggcctttgttgcagacacatttcacaaagattactctcccccttctcttgccaaaaccttgaagagatcttgcagatcttcatcttgagaacctgtgaatttcctaaaggtaaagccaatgatggtatggggtccctgaggactggggacccctggaagtttctgactctcatgctagtctacactcctggtttatcaaaatttccatttgagtgttcctatgagtttatgcctcatgtggcttctgctccaggtgagcagatcttggctatatttccccagatttgggggtggcagtttgccctaaagccacaattctctcgtggttccaagaaatataattgattttccaagaaaaagtccagcttttttgttgtaagaataaaattatgatttccaaagtatttacatgtcagaacaggagccagatgtcccaagtcatttcctttacctgagagccttcaccagcttctaagcaagaaaaagaaaaatctataaataagccaccatctacttgttgctattagtaaaaccatttttgtgttattagtaaagaggaaggaaatgctgatgtattgacttctctatctgcccattctctatggaggaggaaagccagcagaaaagtgctgaaatatctttgaggcataaaaagctaagacataccatgatgcaggagtctagcaatctgtccagcagaaggctcagtctgactgtggccatcaggggtgtcttaggagggatccaggcctccacagattagaacaacctccagatatttcccacttctggctagttattgatatgctgtccacaaaatcatggcaactcataaaatcacaaaaatttgcatgttggaactggaagattctcagggcttttttctttttctttctttcttttttttttttttttaacaaatgaggaaactaagtcccagagagtctggttcaaagccatacagttagctcttgacagattgtggggtgggtggcgggggagtgggggcagtctacacttttatcaatgccttttgctttcactctaaattacttttattttcattttattctaccctttggagcataagatttctatgtacttgtatatatacttttctcattagtatgttggctccctaaggagggtataaactggccctttatgttattactaaattcccctaggcatttataacgatgaaaaatgtcaaaaaaaaagaaaaagaaaaagaaaaatatagcagtgctgaagatggggaaaaaaaggtaggctacacttatttatttcccttccaccttgtcatctaggcattttgcaagcatatcacaacagtatacatctgatatatctgctgtcacctccatcacccttccattccacctgagatcgtgttaggaaaagaaatgaggaagacgtttgtgttcttcttgctcattgtttcaaatgatgagaaagactttgatgagacagacagaaagaagaatgaggcaaagcaagaataataaacccaagtgcaatgataaaaccaagtgtgcagtgggaaaatatgcaagactaaatctaaatccttcaatgtgagtcatctgaggatacctttgaaaatggtatttttatttggtttgtctgaaacattatgtagcttttgtcctgtgcttggttatctcagagtcttagctgtcagagaaggaagggacctgagagcctgctttgtttaaagttcctcgtgctgcactggaatccattcaatcaccagggaccagctgacttctgctgaacccaaccccatccacacccacccccagtcctcaacccacttactttacattccaggggtttgggtgttagaaagtcctttctcttgtagaactgaatatgatttccttgtaaatccatgaattggtcttaattacatcataaaataaatatgcttgacaattcagctattaagcaaagtatacattttgtattacttagatgaagtctttctgaggagaaatcttggacaaaacttgacagtctattcttttattttcatggatctccaaacaatatgaaccaaaatggctagcctgagtgatttaaggggttcagcaaattgacctataaaaaaaacggaggccaaagtagtttgaaatataggacatagaaatgtctttacttctccccaagtagtgaatgatcacaggtccctgtggggtactcagggcaggaatatgcccccaatttgtggagatgaaggatcactttctcatctagagtggtaaattatattaattggagaaagtggtgaattatattaaaagaggcatttccagttccaactcttcagatacacatggaaatgggcagttgtgagtatatttagagacaccatgttgcactagacgttagagaacgcgagtgtcacgttaaatggtgataggtgagactgaaattagttatctgaacattctctttttcagaaagatactggaccttgcattagaaaaacctggaaaaagttacaaggtatggagacattattgatgtcaaacatgatttcagacaggctgtttgttctaacctcagccaaactccggccccaccggggaggcagcaagcagatagcaggaggaatgtggaagagagaaaggcttacggaaaatggaccaaagaggaaacaaggcagaagttctccatctcttttgattggggccaactatgagaagagatagccccagtgagaaaaagtgagctctaagctccagggatcagcagggagccatgaggggaaagttttagtacctgagctctgtgtatatacaagaaaatgcaaatacaaattgagcaccaagaaattacacatctatacgcagaagggataagaaaaaaaggcaaatttacaatgtgacatcactaattaaaagaattagggaggggcaagagggatcctactgtagtagatcccagactttttgagtttattaatttttaaaactagaatgttgagttcatttgtttaaaatattaaatgtaattcaaataatggtatcttagtgattattcaaaatcaaaattttatttgtcaaaaagaatgctgaaaaaggtcatattcaaaggaaataatgattatatgactaaagatagtaattaatttctcaggaaaaaaatgatccacccacacataaaatccttcatctttgtagaaacttatttgaggtaaccctattttgctcccttaagctcacctttgattgaacaaagtaaaaatagtctttctttgtctatgcatttactttaataaataggcatctagaaacatcagaggcaataatatatcaaaagctaactgaattccaccaagctgttttgaaaatgggatttctccatcttcgaattttcaaaagcaatttatctcctccacaggctgacaaaaaaggaaagtttttgatgccttactctgagggaaaatttcttgatttcaaatatgtaaggaaaagagttctctgcatattttatcttattgtatatatatatacatctatcactttgtttctttgtcaacctcatagccagaattactgactgatgatcatttgatgtaccacactaatttcagtgagagttgtactgagtgttttatctcataaatatgtttataatctctaataaactaggtatgcaatttcttagtgaattttcaatggtaatgcaaagctaaatatcaattaattaaagagttctgggggtggaaaaggggacaagggaaaggaaccactcttggttcttacaagatggaatttgcaagagaacttaaattacaaaggaaaaatggcattaaattaatatctaatttctaagctagttgaccaaattatttgaggcttattggcgttctcttgcttagtattgatatagtacttacttaacttgctatcaccataaacaaaaacaaacaatgatgacatgctcttcaaactgaaaagctgcaggtagcattccccaccttcaatagtagctgcctgaatctgtgtctctccatataacctttgaaatcaaaccgttcaatgaggatattaagaaatatcacccctaaccctcatgtacaacaaaactggaagacaaagaatagtttagactctaagtgtaatgggaagaacctctcaaaccagcagaatcagtttcagactcctgactaaagtctctctgatggacaaggatggaagaggtgtgactgcatttgaggatgtagcagggaggaaaagaaaaagcacccccccaagaagaataggggtggatctcaggagtgtactgagatgggacatagagaacagggacatgaggcctcagggatccactggctactgtggaattgaaagaaagaggcttgatgtttcaaaggaccataggtgtaagtcttctagtaaagaagcaggcaatgtggaggcttgctggtaaaggggaaaagatagcaaaagctagaagttataggaagaagtgttatacatcaggaagcactgtggccacctccacacggtagaagaaagcaacgaaaaaatataccccacttacaagggcaacaaaaaaatataaaatacttaaaataaatgttgtggccaggtgcggtggctcatgcctgtaatcctagcactttgggaggccaaggtgggcggatcacgaagtcaggagattgagaccagcctagccaatatggtgacatcctgtctctactaataataaaaatattagtcaggcatggtggtgcaagcttgtaatcccagctaatcgggaggctgaggcagaagaatcgcttgaccccaagaggtgaagttccggtgagccgagatcgcgccagtgtgctcagtctgggcgacagagcaagactctgtctttaaaaaaaaaaaaagttgcaagaaatgtggaaaaaaaactcatgaataagccttgaaaactctcctggaagacccatgatcaacttgaaccataaggaaaatgccccttgttcatggacagaacaagtcaacattataaacttgccaattttcccaaaaagaatgaataaacaatacaatcacaatgaaaatagcaagaagtttgttttttccccctcgagctagacattcgattctaaaattcacatgaaatataaagatgggataatagctaagaaactcctgaaaaggaagataaactgggtggggggcagccctaaccctatcaggtattaaaatatagcattgagctgctgcatttaaacgattctggaaatgttccatgaatagacagaccaatgaaacagaatagaaagtagatccaagtatataaaaaatttgtgtttgataaaggatgaatgcatcctttgttatacacagactttcatttgggaatgtataaatttgggggaataatgagctttcattaattactgtagaaattatgaactttcattatttattggggaaattatgaactttcttgtaaataatgttgaaacaattggtttcatttgtaagagaaaaacgtggacccatacttcacattatacttaagaggaaattctaaaagatctaatatataaatgtaaaattgaaaccacatagtactcagatgaaacaaaactttgaagggaagaaaatactcaaaatccagagacaataaaaataaaagaaagaattaataaattatattctctgtgtgtgtgtgtctgtatgttttaatataacaaatagaacaggaaaaataatcaaagctaaaataaaagaacatgttttcacctgaagaatttaaatctgtgaatcaaaatacttcatctattatcagttgactaaaaccatagacctggacacagttttgtaaaatttataaaagctcactccccaagtatttcagcagaaaagtcaatctacctacaatttaataaaaataatatttgtctcagacttttccatagcaatgaacatcagatataaataaaagtaacatttacagagatttaaaaaagaaagattgtaacccaagaatataaactaaacaaattttcactcatctgtaaaggtcaaagtaaatagtcaagtctttaggaagtagttcacttccatgccattttggagaaaaataaaaaaataataattgaatatgtagtacatcagagcaaagtaaaaaacttggtaatatgaaaattgtggtaaataaagaacattcaggttcatttttaaaagttgcaattattgaaaatactcttgaaaccatagggtaaatattttgaaaatgctcctgaaaaagaagagtctccagtctttccctctgtctctcacaacacacagccacaaacacacttacgcacttttaaaatattagattattacaaccaaagttaaaaattagctggagaagaaggccaaggaataaaaagcagccagtttcctaattttctataaagaagcatcaatagaaactgttttatgttggcaatactaattagataaatattggttcaagtgcatgttctcagatttgaagaaacttatcagataattaaaaacaaaatatacctctttctagttattagaagtacaaagacattaaaaataatcaacttacaaaaagcggaaacaagaaaataaaagcacacaagcaggaaaataaaggtatgaaatgctaactccctaaagtctattattttctcatctataaaatgtgggttataacaaacctaaccataggttaattttgaagattaataagataatgttcaaaaagtatttctcagtgtctggctcacaatcgaagctcaaataatgtttattattactatttataataaaatatgacagttatcaattatgaaagtaaattttcatagttaaaatttaaataaaatattaaacctttcttattaaagggaaaaattaatacaataaataaaataacaaagagaattaaaaatttaggcttgtgaaaaggtatctcaaacaacacaaatcaaaagaaagtaacagtgtagaattccaagtaaaaaagcattagatgatgcaaagatggtcattttatatggatacatttttaaaaatcacagtgatgataaaattgtcataaaatttaattaattaaacatttatctttacaataaataaaagtatttggaaatacaagggataagaaataatttttaatgctttgctctcagtatttataaatcaagaagaccaaaaatagggcaaccctcttttgggccccctgtccgtggtggagagctttcttcaattgttcattaaactcttgctccaacctcaaaaaaaaaaaaaaaaaaaaagaagaagaagaagaaataatataaatcaagatgaccaaaaatatacctaagatggtagaggactttaataatgtaattaattagatttaattagtgtatattaaacaatatacctttccaaggttttggaaaaccttaacaaaaactatatcttatgtagtctacaggatttaaaaaaattttatttgtatatgacacactctatcatgactatgtaataaaaataaaaactaatgggaataaaacatttcaaaaaatccagtaattttagaataaaaagaaaacattgtaaatattagctaaaaagaaaaagaaaatgaaagttactactacaaaccatttagaaagtaatgaccatgtaaaactatatgttaaaatttctgtaccaagacaattaaatgggaaaagaaaaggcctttcagcaagtggagctggaagaactagatagccacacaagagagaatgagttgaagtcctatctcacatacaaaaattagcaaaatggaggagctaaaactctaaaactgttagaagaaaataagcataaatcctcatgatcttagaatagacaatggtttcctagataagacatcgaaagtataagctgcaaaagaaaaaaatacaaaaattggacatcatcaaaattaaaaacttatgtgtttcaaagaatgccatcaagaaagtgaaaggaaaatccacataatgggagaaaatttttacaaatcatgtatcttataaagcaggggtccccaagccccagaccacagactgtaccagtccctggcctgttaggaaccaggctgcacagcaggagatgagttgagggaagtgagcattactgcctgggctctgcctcctgtcagatcagcagcggcattagattctcatggaagtgcaaaccctattgcgaactgtgcctgcaaggtgtattagtccattctcatgctgctatgaaaaaatacctgagactgggtaatttataaagtaaagaggtttaattgactcacagttcggcatggctggggaggtctcaggaaacttacaatcaatggctggggaggtctcaggaaacttacaatcatggtggaaggcaaaggagaagcaggcaccttcttcacagggcagcaggatggagtgagtgcaagcaggggaaatgccagacacttataaaaccatcagatctcatgagaactcacttactatcacaagaacagcttgggggaaaccacccccatgatccaattacctccaccgggtcttacccttgacacatggggattacagagattatgtgaattataattccagatgagattttgggtgggggcacagccaaaccatatcatgaggaatcaaggttgcacactctttatgagaccccaatgtttgatgatctgaggtgcaacggtttcatccctaaaccgtgcccctccccctgcgcttcccaccccctgttccaattttgtgaaaaatatctttcatgaaactggtctctggtgtcaaaaatgttggcgaccactgttacaagggactcgtacctagaatatgtaaagaattattacaactcaataatagaagggtaaataactcacttttaaaaattagcaaaggatttgaatagacagttcttttaaggagatatacaaatggccaataagcacatcaaggattgcttgacatcatcagccatctgcaaaatcgaaatcaaatccacaatgagataccacttcacacctgtgacgatgcctataacaaaaaagatggataaaaacaggtgttggcaagaatacggatggagaaactggaatcctcatacactgctgctatgaatgtaaaatggtgcagccactttggaaaacagggtggcaattccactcccaggtatataccaagagaaatgaaaacatacatccacacgaaaccttgtatacaaatggccatagtagcattgttcataatagccaaaaagtggaaactacccaaatattcatgaactgatgaatggatttaaaaatgtggtatattcttataatgaaacatgcttccgtgataaaaaaaaaaaaaaaagaaatgaagtgctgacatgtgctacagctgagacaaatcttgaagacatgaagctaagtgaaagaagccagtcacaaagaaccccatatggtatgattctgtttatattaaatttccaaaataaaggaatttatataaaatgaagtagattaatgcttgccttgggctacaggggctggagcaattgagggtgatttttaaggggtgcaaggtttatttgtattgtcatgaaaatgttctaaaattgattgttgtaattgcagaactctgtgaatatactaaaagtcattgaatcatatactttaaatgggtggattgtgtcacatatgaattatttctcaatagagctgtttaaaaaaaaaaaaacaacttgttggccgggcgcagtggctcacacctgtaatcctagcactttgggaggccaaggcgggcggatcacgaggtcagaagatcgagaccatcttggctaacacggtgaaacaccatctctactaaaaatacaaaaaaaaaaataaaaaatagccaggcgttgtggcaggcgcctgtagtcccagctactcaggaggctaaggcaggagaatgacatgaacccaggaggcggagcttgcagtgagccaagattgcgccactgcagtccagcctgggctacagagtgagactccctctcaaaaaaaaaaaaaaaaaaaaaaaaaaaaaaaacaacttgtactatgacttcaacttccaagtggaatgtagatgttgtgattgcccaatgttcccaacacaattactggacaaaaagccagacaaatgaccaaaatcttgtttcaagtcgccatacagttgtagaaacaataattagatgaactggaatttcacaggaggagacttctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagatagtggatttgccacagtcttccatgtttgagggagagtgacccactagtctctcagcccaaatccttgaagggtcttccttgagaaacagggaaggaccaaagatggatgagtcttaggaaaactgcatatgtgtaatagaactaagaggggaagcgggagagagacaatgggccaaaagcaacaactgaagatataatggcaaagcatttgccaaaatggataaaatattaatacatcaattcaaaaattcaagaaaccctaagtagctcagcaaaccccaagtagggtttaagaaaaaagaaaatcatactaaggtacattacagttaaactgctaaaacttagcagatgagctcaagtttcttttctgaagcaaattcatatccttaaatagccttattaaataataaatatttaaaaattttaaaactacttattcatcataagaaattaagaaaataataaaatctaagattcacaggagattgggttaccaaaaataaatgctgaaattaaattatcaaaaaaagggaaaacagttaaattgataaattaataaatcttaaaggtggttattttaataataaaaacccaacaaaagacgtgtatttactttcaatgtttattattttaattaaataaatttgattcaaattaaaaagcacaaatgtgagagtgaaaaaatgacatgactacagattcaaaggaaactacaaaaataagagaaactgcaaaaatatgccttccataaataaatttgatagttttaatgaaaagtataatttctggccaaatataaattataatattttacttaagaagtagaatatctgaataggcctattactatgcatattactaaaaggattattcagaaattttaaaatttactacaagattttacaagattaggttgtatcacataaaattactttatgctatatataatagagtacatatgcataataattggctatatttgaatctcaatttatttttgacattaaattaacttgttaccaagcttgagaaagcactacaaccatgcaactaaaaaaatagcacatgcgacactctcacttatgaatataggtgcaaaaattctaaaggaaattctaacaaatcaatttcaatgctaaataaaaataaggccataccattttaagtagaattattctaggtatgcagacttacttcacactaggcaatctatcagttgaattgatatagctacagttcaaagggaaaactacacaattatttctacccatgctgaaaacacattaataattaagatacatttaaaaattaataagctttatgttttagagtagttttagctttacagatatattgagtagaaaatacaaagttcccatatactccctctccctaccacagtttcctctattatcaatatcttgcattgatgtggcacatttattataattgatgagccaatattgatacactattattaactaaaatcaataggttactttaggtttcactcttggtattgtacattctagggattttgacaagtgtatagtgatgagtacccaccactaaagtatcttatgtaataatagtttcactgccttaaaaatcccccttgtactacctattcatctctccctgtcctccagtccccagcaaccactcatctttttactgtctccaaagttttgccttttccaaaacgtcatagagtaggaatcatacaatatgtagccttttcagattggcttctttcacttaacaacatgtgtttaaggctcctccatgtctttttgtggcttgacaactcatttcttttcattactaaatagtattccattgtatggatgtggatgtaccatagtttatttgtccagtcacctattaaaacacatctgggttgcttctaaatgtcggtagttaagaggaaagctgctgtaaacattcatgtccaggtttttttttctgtatgtaagtttctaattcatatgggtaaatatgagggagtgttactactgagtaggagtatgcctaattttgtaagaaactgccaaaatcactttccaagtggccataccattttgcattcccactagcaatgagtaagaggatctgctgcacaacattctcatcagcatttggtggtgtttatgtttgggattttggtcattctaatgggtgtgtagtaatatctcgttttaatttgaaagtctctaatgatgttgagcatctttccacaagcttattttccatctgtatatcttctttggtaaggtatctgttgagatcttttgcctattttttaattggactgtttgtttcttactattgagttttaagagttctttgtatatcttaaatactagcctgcatctgacatgtgtttcacaaaatcctcccagtctatggcttattttttcattctctgaacagtgtcatttacagaacagaagtttgaaattttaacaaagtccaacttatcaatttttttatggattgtgcttttggatttaagaagtcattgccaaattcaaggtcattgaaatattctcctattttaccttctcagcattttacaagatatatttttaattaaaaacaaatagatgctctgaatcagtcatggtccccacaaggatttttaatagaaactgtaaggaaaagacaacttacaatgggcttggtaaggttaaggaaatatataagggataatgcttgcaaccatgataagctgtcatcacccaggtcaaaaggaaaaaagggaggagctagtgctgggacccagtgtggaggctatggtgaagaagctattattgtgaactccactactactataggtttcatacctaggcaagaagagcatgtagtcctcataagttgatagatataagaaagggggctgggcgcggtggctcacgcctgtaatcccagcactatgggaggctgaggctagcggatcatgaggtcaggagatcgagaccatcctggctaacacggtgaaaccccgtctctactaaaaatacaaaaaaaaaaaaaatagccaggcgtggtggcaggcacctgtagtcccagctactcgggaggctgaggcaggagaatggcgtgaacccgggaggcggagcttgcagtgggtcgagatcgcgccactgccctccagcctgggcagtgagagcaagactccgtctcaaaacgaaaaaaaaaaaaaggagccctaactggcaggaacaggagcaaggatgggggagagccatcattctaagaaatggctgacaagccatcgttctgagaactggttaaccaacaacaacccacttgcacaacaccctgttcccaaataccttgttttgcacatagacccagcagcatgaccttatcagcacgtaccctctccagcacaagcctataaaacttccctccagcccctgactcttcgagacaacctcctctctgctgtgcacctcattgttctcttgcagtgtatcttcgtactttctacaataaatctgcctttctttatccatgactgtcttggtaaattctttcactgcctgcaatgctggacccagccagtcacaccagcagcattttggtggtccatatggagacctctcccctgttcactgttttttctcttctccaactccaacctcttagtggacagcatccaagcctggagacatctgatggccccccactgcagctactccctggtggatcagaaggtcccagtggaaagaagtttgaccgtcactgcccgatcgagtgagagtttagagtttactttcctttcccgtcttctggtggacaaactctagtatccctctagcagctgatggccactggccagggccattccctggtgtggcctaaaggccaaggagtgaaccaggtttggctgccttgcttggaagggaggatggctctctcctaacccttctggtcaaaagtccccagtccctacatgcagcacaataggcagcggcagcttgaccagggcaaacgcacacacattttggggaactcagaccccgtccttctcactctaaatttctcctgtgaagaaagccagccatccttttctggacattttaagcaacatgatcccaaatagcaccagaacagtgagccttccctcaacctttgccccttatacctggattcagcacccagtataattcatacgtggactgacctggggctgctcaccctgtgttcatccatccagtgtaaggctctcatgctgggaggtcctttctaataggtgggatgcccctttggaaagtgcctctcaaggctcctcagtggacataagtggaaccccctttccttggctggaggccccaagagaaattgtggtttgtgtccccagtagacattattttccaatccccccatgggacaaagcccttccattctctcagactcaccgatgggctgcattctaaaacattgggataaacttgactcccagactctcaaaaggaaacatcgaattttcttgtgtaatacagcatggccactttataaacttccagatcaggaatcctactggcttccaaatgggacctctgcccccagtagtattttataggttgacctctttggtcataattcttctaaacggcttgagattccttatatctgaggttgtgtaactctttctaagtttgctctcctctcccttacatggttccttcctttactaggacagctgcatttatacttctacttctcctcttcagtcctttgtctctttaatttactggttaaatttgtttcttccagaatgtagcaattccacagcaaactcctaatgatgcaaggatatcagccaatcaccctcagaaaaccccatgaatctcctctagactcactagatatcaattccatattaacacgctctttcttcctgagttctatcctccagcagcatttaatagactaagtcccataactcaggacaataacccacagggtcccctaacagaccaataatcacaggtagggcccacactgtgcccacagtcagcaggaagcagttggaagataagacctccataccaatgccaaagatttgtcattgttgttctgtcagcggggaacatggagtcctggtaagttaatagatacaagaaaagggctctagctggcaggaacaggaatgaggattggggagagccactgttctaagagatggctgacaagccatttttctgagaaacacctaaccacaaacaacctacttgcacaacatcctgttcccaaataccttgttccacaggtagccccagcagcatgaccctatctgtacatagcctctccagcataaccttatcaaacttctctgctgtgctgcctgttgctctcttgtatctttgtactttctctaacaaatctgactttcttaacccacaactgtcttggtaaattcctttactgcctgtaacaccagccccagcctatcacacctgtgacagatggagaggatgaagtacctttacttctctctcctcaccctcaatagcatgccagtgatccttgctggccaaacacaatcagagggcagccagcaagggagcctgggggctgctgtctgcatgggtgatcatcctggggcacaggcagagccaacatgagtaggctatccctgtgagagagggcacatggagcatgaggaccacagctctttgtgtaaccaaaaattagtgttccacactctagactcttgcagaccaagggttgaagctgagctctagcactcattggaaagttgatgtctttaagcctctgcattttatgtgtaattaggattaataacagtgctacattatagatattaagatgactatttatattaaatgtttgtgaagtattaatgagtgcttagtaaatgctagctgctatcactactgctgccactactatcaaaactactaccattactactactaataacataactactattgtcactactattaccactaccattagtactaccaccactatcatcactaccatcactactaatactatcattaccactactattaccattaccacgactatcattactactactaccacctccaccattactactactaatgctatcattactactactgcttctataattactactcctactcctaccattactactactagtagtatcaccattactactactactatcattactattaccaccaccattactactatcattactactactaccaccaccattactactactgctgtcattactactactgctactatttactcctaccgttactactactaccaccaccaccattactactactatcattgctactattactactgccatcattactattactactattagtttagtcattattatcagaggcgaggagaagcaggcagcataaccaagaacataagtattatttctcaatatgagacagaatctctatattaaattaatagccaaagccatacccaggaatgaaatatttacatgttctcactgaaaccaagaaccaaataaccagaggattgctaccatcattatcattgaatgttctagaaattttagccaacatattaagatatgcaacattaggaaagagaaaaagtttaccttttttggttaacatttacaaaatatgatggttctctgccaagaaaatcactccccaatttaaaaattaagtggctaaacacaaaatgaatgtataaaatttaacggttgttctgaaaactaggataaaactattcataatatttaatgaagataattttccacttacaatagcaacacaaactattaagtgcctacatagctttatatataattttgcaaacaatataaaggctagtaaaaaataaaaacaaaaaacttataactacattaagaaaactgggcacagtggctcatgctggtaatctcagaactttgggaggctgaggcaggaggatcgtttgaggccaggagttggagactagcctgggcatcattgcaagatcacatttttacaaaaaaaaaaaaaaaataggcacgcatagaggcatgtgcctgtagtctgtttacttgggaggctacaggtagctagactacagtaatggtagtagtagtcatggtagtagtagcaaaaatgacattggaaaaatgtcgattttttccaaattcatttataggattaacacaattgcacttaaacttccactgagatttattattaaatgtgttcaagtaaaactaagattcatctagaagaatgaatttataagtagagctcagaaaaaattttttaaatgcaaaacagaaaagattaaccagtgagatttgccctgttatatatagaaacataacactaatatagacaaaatatgtggttttggcacaagaatagattattggaacaatgaaatgaaacagaaactctgggaaaagaatacctacattaatataatgaagtaaacccagacatgtattctgacacattacccccaaagaaataccaggtggattaaatatttaaatgtcaaaaataagccaccataaaaatcttagaagaatatgcagcagaatatttgtgtatctcacagtgaaaagagggttttacaagtataaaggtaatacaaaatagaacagaaaattgatatgacaacatgaaagaaaaccttttatatttcaaaagtcagctttcagtttttcccagtaacagccattgtttataaccttggggtctaagtttccaggcttgtattggaacaggattagaaaaggaattatactatacattgggtgactgtgtcatcaccctctaggatgatttcttcttggaatgagacttaagataccatagttctactttcattgtgcattgatacattaagtcatttataacatttcccaaaactccaatctggagaactttctctatcaccagggcattgctttggaattcagggaggcctgagttctggatgggaatgggagtgagatggtccagtgaatgttaacagtcactattattatccttattttacagaggaggaatattctgctcctttatgagccaacatttactttctctgaattaaatgttactggtttcttatttatagacagcagagattgactgggcacactttcccccacagtttccaagactctgtaattatatgcaaaatagtaaaattaaattcaatctagatgaatccatatttcaataaggatattagtgacttaggtctaaaaattaaaattagactcgtcaatcctgttatgctttccattcaaatgtttttcctaaacagcaacaacaacaaaaacctgatttcctaatagtccatttagcttttatttcatgccatttacaaagtttaggcaacataaatgcactttatgcatatctctgtcccatatctcagtctagatagttgtctagataattttctagacaacctagataatcaatgggaaggctgaatggcagagcagaaaaaccatgtcttcagggtctgaactattgagagtaagtatcatctccaccacttaacaactgtacaactctgggaagatgtgctgggcaagccctttcagtcttgttggcttacccagtagtcaggatttgttgcaagaatacagtgccagctgtgttccagccactgctctcagggtactgttccctttccctttatatgttctgatatttctcccatagctaccaaccagcccattcttccagtctttctctgttcagatgctaatgggagagagttgatggtcttagatagtcaccataatccctttagagcagagatttgttgtagaagccaggccactttgaaggacacaggctgcctgatattctggctgcccttgggtcagatctcatccctggccaaagtggtgccaccactttctcaatgattgcttatttctccctccttcaacatgctttagaaggcagcgtttcccttagaggagcacagtgggctgggcagcaacagtggatgacgtgcgtattacggcactgctgggtatcatcataaccaacatgaacttgtggcttgttcttacaatgcgccagacgtctcatgaaacattcaacgtttcttaattcaccctcacaaccagaatgaggtaagtgttgttcttattcttattatttgatattttatagataaagagaagcttacagcatgaaataactttctcaaaatgataagatcagtaagcggaatattcttttttgtttttttttttgagacggtgtctcgctctgttgcccaggctggggtgcagtggcccgatctcggctcactgcaagatctgcctcccgggttcacgccattctcctgcctcagcctccccagtagctggaactacaggcacctgccaccactcccggctaattttttgtatttttagtagagatgggatttcaccgtgttagccaggatgatctggatttcctgacctcgtgatccgcccgcctcggcctcccaaagtgctgagattacaggtgtgagccaccctgcccggccagtaagcggaatattcaattggattccagagtttatgcttttagctatcaagctatactctttctcactatatttccctgagctttggtttccttatctataaaactggaaccgcactgcctgtttgcctttagagctataggtaataaatgttatgcatttattatggtaaataacatgtagtagagcaaagcatggaaattcaggaagtaacaaagagcagtcataagaatgtctatgtggtaaatctagataaaaattacttgtatacacatttacagtagcgcctttaaaacacacaccgatagcactttagtaagtcaagaatgcatgttgcaccaattagagaaaacaccaattttttaaaaaaacatataaataacaagctaatagaagaagaaatgtaattagaaaaatttaaataagcccaaaaactttaaggaaggacaaaaaaaatcatagaacagagaaaataggaatcaatggtaagatggtagatttaaccttgaattacagtaaatataaacagactaaatattgaaattgaaatataaagctcatcagagaaggtaataatatcaagcaaagctaaacaagctgcttactttaaatataaagatatcgacaggttgaaagtaagtaagggatggtaaaactactatgcaaagcaaaagttacaaaaccaaagcaaagactggctcgtttcagaataatcaacgtttcaggtttaatatgaaataatcgtaaatttgtttatacctaataacatagccataaaataaaaattgacagataaacaatcatgttaagagcctgtataagccagatttctccagaaaaacagaatcaaaaggatatatacattaagaattatattaagaaatttattttagcatattggcttacatgattgtggggctggcaagtccagaatccgtaggagaagctggcaggctgaaactcaggcaggaaacgatgttgcagactttaggcagaattttttcttctctaggaaaattcagtttttgctcttaaggcttctgattgtataaggcccattcacagtatgaaaagtaagatttatgtaaagccaactgattgtagatgttaactacatctacaaaatacctttgcagcactacctagattagtgtttgattaaataaatgggcagtaaaggccgggtgcagtggctcacgcctgtaatcccagcactttgggaggccgaggcaggaagatcacttgaggtcaggagttcaagaccagcctggccaacatggtgaaaccccatccgtactaaaaatacaaaaattagcctggcttggtggcgggcacctgtaatcccagctacttgggaggctgaagcaggagaatcacttgaacccaggaggttgtagtgaaccgagatcgcgccactgcattccagtctgggtgacaagagcaaaactctgtctcaccacaaaaaaaaaaaaaaaaaaaaaaaaaaaaaggcactaaagcctggcccccatgatgacacaggaaactaatcgtcatggagactttatccacacttttgaatatatgttacatttcaacattaaaacacacacacacacacaaaatcataaagcaatcaacaaaattaagctgaatgcttcgtaattgctggattccctgggaagctgactctgagatggagattagcgtgcaggacatttcttacgggttgttcttgggatcaatacctgtggagaggagaagctgaggcaggatcaggaagcggggaagtagagtgcaatgctggtgaagcggcatcactgtctggggtaaatatccggggttcatcatctctcgtcaagatgattaacgacatggacacacatgggtgagttaagaagcggaaagtttaataggcggaagaaaagagtgaggagaccagctctcagacatccttaagggaaaggctggcccgtgactgacggcagcaggttttacgggcaggcttgaggaggcggtgtctgatttacgtggagcccagagattggttcgaccaggggtgacgtttacgtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccaggtagtgttttttgttgttgttgttgctgctgttgtcgctttttgagtcggagtttcgctcttgttgcccaggctggagtgcaatggcgccatcttggctcaccacagcctccgcctcctaagttcaggcgattctcctgcctcagcctcctgagtagctgggattacaggcgtgagccacagcgccggccccaggtagtatatttttattggcacaactgccggtatttgcctgtgcaagctttcagcttgcttgtctgtgtctgcagctcgattttccaggttgctttttgttagaaaagaaaatgatttgggggctgcttttcattaaaaggaagaccttactgaggactcccataccttcactatctgcctaagtactttcttcttaactcctatatcactgggtcagcagcaaccccagtcaaacctcaagggagacgggaagatgggacgatctgtcagaggtatgctgagttgaggcaagagagctgacctttatggattgccaatcagtgactcattggaagtggggcaacctggaaggaaatgtggccttaggtgaggcagctgtcttcagaggaggcaatttctttgtatctggaggggcaattgttagtgttcccctggactgaagggtgaattatggagaatggaatagaacgatttgttactatgatttggttgatgacttatttcctgtttccttagcttcatcttgctgagcaaaaatgaaggagcctggacccaactttgttactgtgagaaagggtcttcattcattcaagatggcatttgttaagcacctactgtgagtagatgatctcctgtcaaagacagttaacaaatcctcggaatattgcttcatgtacagttattggagatgagtaacttacattctcttaattgtaatggttccttggaaagtcatcgtggaaaatgaaggctggctcatacattttcccagacaggaatttggctgccaacagggaattctaaacaactaaaaactccagatgatgaatgcacaacataatgatggttaaattaaaaaaaaaaaagagcacggtaataaaatttccatgaaatattttgtgtaagcgcagataatcagtcattttctttatagaattcttattcgtaaataatttagaatactttgttctttataatatatgatgggcaactatagtatgattcttctgagtgactcagttcttttttttttttcacatttaatgactttgtttctcctaagtgaatgcacagatagtatattaatcagggttctctggaaaaaccagaaccaatttattatcaggtactggttcatgtgattgtggaggctgagaagccccatgatctgctctctgcaagctggagacccaggaaagctgatgaaagtcaaaggcctaagagctggagggccgatggtatagattgcagcccaggtctaaaggcctgagaaccagaagcacagagggcagaagatcaatattccagctcaatcaggcaaagagaaaaagtcctcccttcctctccgtttttcttctattctgaccctggatggactggatgaggcccagccacattgaggagagccatctgctttaatcagtccaccaactcagatcctgatctcttccagaaacaccttcacagatacacccagaaataacattcaacctgttaggagtatcccatggctcagtcaagttgacacacaaaactaaccatcacagatacacatcaaagttaaataatattaacacagactttggcaagctgtattttaaaacacagtaggttagtgagtctggtttaagagcactagatgaaaccacatataaggatgtttttgacattctgtgtctgacccttcagactccctgccctcctccccaccatgttctgaaccccagaacactgacctctacgaacagccccacatgggctctgttaccctctggcttcccattggcccatggaggcacagaggaagttggggcaggaggacagaatggttgaggtacggatgctcgagctctcaaggccacaagtcggcaggggctacattcctgtgtgaagctcactacccctcagtcgtctcctctagctctctgtggggtccggtgacctctctccttacagtcccattagccctaggggaggtaatggctctccagggagtgctgcccatgggtgtctcagtatcacttgttggttcccatagccccacccacacctgtgtaaataggccttcattaaccttagctcagttgcctggtttgagtgtaccatctgtttcctgccagcactctgactgataacagcatttttgatataggtctccatcacatgtatgtacctttgtgtcctctgtattcctcattgatcagggttataaattttctcttcctgtgacactaaattgcccttaataaagcttattgaccctaaaagtcaaagggggcaaaatcagagctagtctcaattccttaaagtggacattatacagaaggttaggaaatattaaatacaagtattcacatatgtgttccccccgtcaagctaataaacatatgtatgtgctttttgaaaaccagtgtaaccgcaggttgtctcttgttcctagtaggtgctgattagagcaatgagttccaacttggcagtttttggaaactgaacatgagctgttaatgtctctgcatcaactcgggtttccttttgcttttgtttaaattgaagtttttcacttaatataagatttagagatttctgtctcagagctcgccaagatttgctacttttgtctacccttgtttttaatcttaaaaatttggatttacttaataattccaagtatgaacattaatgttgcttttatcttccattttactgcacaggaggaggggaacagataccaaactactgattattttacttccattgttaatacacatgagaatataagtcttcttgtgtacctggaacttacaaaaattggtttcagctactcaggaggctgaggcaggagaatggcgtgaactcaggaggcggagcttgcagtgagccaagatcgcaccactacactccagcctgggagacagagcgagactccgtctcaaaaaaaaaaggaaaaaaaattggtttttaaaaaattacataacatatgtaatttttaaaacatatgttttaaacatatgtaattttcaaaaaaaaattggtttttaaaaaattacataacatacttatgttaaaatatacataacataaagtgtatcattttaaccattttttaagtgtacagcctaatggcattaagtacatttgcattgttgtgcagctatccctaccatccacctccagaacctttttttatcctccaaaattggaactgtgtacccattacacaataatgccccgttctcttttcctgtaagcccctggcacccaccattctgctttgcctctaggaatttgactactctaggtacttcacataggtagaatcatgcggtatttgtccttttgtgactggcttattccacttaccataatgtcttcaaggttcatccatgttgtattaatagcatgtcttggaattcctttccgaaatttctaaggctgaataatattccattgtatgaacagaccacatattgtttttctgttcatctgttgatgcaaacttgggttgcttctaccttttggctgttgtgaataatactgctgtgaatataggtgtacaagtatttattcaatctttgcttgcagttctttgagctatatatgcaaaaaatgggatcctggattatacagcaattctatgtttaattctgtggaaccaccatattcttttctgtggtggctgcaccattttatattcccaatagcagtgcgcagaagtttttccacatccttgatagcacttgttattttctgttttttgttttgttctgatttatcttttgacatggaacattcttatacatggttacacatccattatggtggtcttcatcaagttagaggctgcaaagcatccatatcattcattcttctagggttaaaggcatttgtaaaatatcaaattcaataacactgctaaatgtcttaaactttgtgtgtgggagggcgtaactactggattttataagtgcttattacacttgaagatgacagatttcttttctattgaacattttaaagaacaatttagttcatcccaactgatattttctgaaggccgctatgtaccaggttctgttacaggtgaatggacccatcagtgaacaaaaccttaaaaaaattacaaatcatttggaaatccactattacagtggcttcttcagggatgatactgttttccaatatgctacctaggaaatgtgcttctttccaaactcactgttatgtctcaagcgattagttcatggctcagaagaaacataagtgagaggtgctccttctacagcccttactttgtgcttgtttctggcactcaccactttcgaccttgtcattcgtgtgcttgttttattttcttacaagactttgagtttcttgacaggatttcatctgtatttgattttctacaattatctgcagcattttgcatataagcattaaaaagatttatttcatttgctgaataataatgaacatggctgttttgtattctttttatgagatggtcagtcacatgcagccacggaggagacacaggggaggctcaggaagacagagtattatactcacaggtcctacaaagaggaggcacgccatgccacgcaggaccacacgggaaaaaacaccagagtggtcaggaggcaggaggcaggagctcaggaaatcattcaacctttactgaggtttcgcgggaaaggcaggtgagcagcttaggatgggctagtttgaatcatcctggtgggctctaagctctagggatggccctagttgtctagtacccagctctggaatggttaaggcagaaattttaaaaaatgaaaatttaaaaaatatatatgtgtacaatatcatacacacatatatacaaaataatacacatatatattgtgtttgtgtgtacacacacacacacacacacacacacgtgacaacttcatgctagggagaatggtgattctagacatcctgaactccagaatgatggtgaaataggtaatgcaagtcacctccccacctgctcctgactcggtcggctccctcggtgggtgagagggttgttggtctgccctttggcgccctctaggtgagaacactgcataggccattctggtctcattgctgcagtttgtacttttcataggaaaaaattagcaagctgacctctgttttggaatgcctcagaagctagaatagaagcccactcactctcctacagcacccctttatccccacacacctgtctttgctaggtaataagcagatgcggcttgcagacacaaagcgtgaatacgattagtaaattcaccttgtgaaatgcagctccaccttcctctaatttggccttaggggttgttttgctatttttatgagtctgtatgtaattagccacaattaaaatctgaagtctctaagtattttcacagtccaatttcatctgaggcaatgaaaaataaataactcacagtgactttattacttctgtttctcagatttggggaagcagaatagtgaagtgggtctcttcacacatccacaggacaggtaggattcgcaggggcttgaaagtcccataactcaagtgcatttcacctgtactgtcaacactgtctatgggcaagacttaaggcagcaacgtccagcaattctttgtgtgcgaggatctcatttcatccttcttccagggaggagaggggtgagaaaaaatgactcccaaacctcttgttaccatcctgtctccacttctgagctctgtcattgtttatgtcatttgtattccagattccaaaaggatatgaaagatctgcctgagatctagtagcatatttccagctggctcttgggaatcaagaatatatacaaagcattgttgacaacaaatgtttatttactctgaagatggtttccccttctgtgtgagtcagggttctgcagagaaacagaaccaatgggatatacatagtgctgtggtttgaatgtgtcccctccaaatttcatgttgaaacttaatccgtattgaggtgatattaaaaagtggagccttttgggaagtgattaagccatgatggctccaccatcatgaatagatgagtgccttataaaagggctggaaagaaatggattaggcccttttgcccttcagccttctgtcacataaggataccatcaaaaaacaccactgatggagcattccctcactagatatggaaccagccagccttgatcttggactttccggactccagacctgtgggaaataaacattctggtctttataaactacctcgtcttaggtgttttgttagagcagcacaaacagacaggacagaaatacatgtaggaggagactggcttatttgattacagagagcaaggagtcccaccatctgctatctgcaagctggagaaccaggaaagctgagggttcaatttagtctgagtctgaaggcttggcaaccaagggagctgctggtctaagtcccggagtccaaaggcccagaaccagtagctctgatgtctgggggccgaggaagatgaatggaccagttcaaaaagagagagacagagaagtcctcctccctccacttttttggtctattcagaccctcaatcaattagatgatgcctgtccacactggtgatggtggatcttctgattcaaatgtgaatctctttaaccatcatagcttctaagttcccacctttcttccatccttgccccatcccttcttctctaacctcaccttgtcctcccttacctctatcctttcctctctctcctgcatacattttgtggaaagcctatgtattaagggtagacacaaggcaaaattgtttctctgttcatggaacttagatactactgcaccagctactggagaaagtattatgcacttgccaagtaatacacaggatttttgtcacttataaacacaacaaagctcaaaatctaccatcatcatattctccttcttgtcactcaaagtcacatcaagaggatgaattgattttgtcctcaggacaccttgtcatgtctcccaactttcctatataactgatggttgttactccagacttttattagattatcttcagtgttgtgggttgaaatgcatcttccaaaagatatgttcaagtcctaaccctgggaatgggaccttatttggaaatagggtctttgtagatatcatcaagtaatgaggtcttactggagtagggtgagccctaatgcaatgactggtatatttataagaagaggaagatttagacacagacacacagggggagaaggccatgtgatgattgaagcagagttggagtgtctacaagtcaagcaatgccagcaatcaccagaagctaggcgggaggcacccaacagactctccctcacaccccccagaaggaaccaaccctgcaaatgctttcatatagaaggcctctccagaactgtgaaggactttctcctgtttcaagccacccagttagtggtgatttgttaaggcagccctaggaaactggtacacccagtcagtgcaataactttcaaatagttctgcttgcctccaacactcacactccatgtgttcccatccttgattactgtggcattctgcacatggcactcaaagctgggtcaatgtgagccaagagaactcaggaaaggagagacataagagagaagaagaccctggagagagaggttttgagactggaaagtaatcatataagccattggatacttgcagaaatcttggggtggtcgctgaacttcccccagagcatgggatgggggaattcaaaggacagagaggcttctgttgccttctgcatgatgtataagaaatctcattgaatcctctctgccactgcatgggctggaactactacctgcacatacagttaggaagctgaggctctgtggggttatctcttgcttaagaatgaccgactggactgacaaagttcagccatagaattagagcccaagatatcctgctctataatgagtattcttccttaccacccttatatctctaaatcaacaaactgggttatttgtttctcttggccctgacttgctatttacctatctggatttccttctctttccctctgcacctggtcaaaagctgctcatccttcaaagtccagtttaaatttaattgtctctatataaatgttcctgagcaccttagcctgaagagacatgaatcagtcccactgaacaagactaactgacatgcatataatttaatttgcacaattgaacacctgctgtgttgtttcttcaattatgggcttggtctctttgcatcttttgttctgagttatttttttcacactgttgtaagctccttgggcagagtccataatttatacatctttgtatacctagtgggtctcagaacagttccttgcacacacaaaaaatgaggcaaaatgaagtcagatgtcttggttctcaatacagtcatctgttctggagttgttaagtgtaggatatcgaatgcttttcttaaacttcctggtctctgtctcctcttctttgacagtaggggtttgaaccagcgaatgtcagtttccttcagctctgttggactggggcactgctcctttagcttagggacacatgccgggaagagggaatgtgggactcctctggcccaatttccaggcacctggggccccagcaagcttaccttgtcagattcatcagatggttggactgtaggcatgaccttggtgttccttgcaggaaacaaaggccaggtgtgatgctggcagtgtgtctgtgtgtctcaggagtctctctgatgttccgtctgaactacatgtcgggagatgccagatctcaatccgacagatcaagccacatgtgcccagaaaggcttttggcgacatcacattcacttaggagctgtggtccatagggggctggggtatgatattctgaatggtgacggaaataagtgttcttattcttgtttacagtgcctttttgggaaaatgggtgaaataaggttctgtgtgagtgtgcatgtgcgtgtgtgtgtgttgaagtagggctggaatggaaacatggggggaaggatatttgaagctctgtagtaccgttccttattgaagtaacacccctcgcctaagtataaacttgtggatggcttccccagtgcaagtttataagtttgtaaaccccaggctctgcagattagatgtatgggcaactgaatttttttacacaagcagagaaattttaagaaatttaaagcataatcatgtacacccaaatgctggtggtttgtgctggcttaagaagcaagaatattcctttggttggtgtagcatttctctttactgaacagcattaaaatagcaacaaccgactatacacttcagagagaaccatctagacatggagagaaaagaatcaatcttgtttgtaggtagcaatgtctggtagtatccataaaatataacagccaaggaaatttcaagggagtggagcaatggagattttgtgcttaaagagggatcaattaattggcaatcatgtacaactctaggtataattatatagaaaacaggcaacatgagatcatttatttatttttatgagggaataattttattttatgctcattttactgaggctaatttcttcttattctaagaagtaaatgtgaacatgcctattgtgcatttgcaaaggaaattcaaacattgtctttgtttcagaagcaaatgctgtaaatgttgctatttcagaatgacttttatcatagttatagatgttctcatttatttgcaaatacatttaaagtgacaaaaaaggaatacttggggatttaaatagcatgttttcaactttaactgcatactgtatttagaatttaaaggggatctctgatctttgttttctcatacgttccacttgaggccacattattctagggcagtggtcctaatccacagattttagtctcttttccccacccctccagggcacatctggcagtgtctgggggcattttgattatcacaatagggagggtcccctagtacaggattctagtaggtaaaggccagagctgctgctagacagcctaaaacacacaggacggttcccatctacaaagaataatccagtccaaaatgtcaggagtactgaaatggagaaaccctgctcaaaaaaaaaaaaagaaagaaattttatttccttcttacaataatccatagttaatctctgagccccattttgtccacaacagcatggtgtcgtgacctaaaggtatatctcaaaagaatctctcattcttatcagtgcagaatagagaaattgtgtgcagcctacgtgtgatttgtcactttagtactctgtggtaggttatttgacatttcatgcttcatagtctgaaatgccctctcttagtatacccatctgacattttcgagagactaatgtttgcctaagaatgcttaaacgatggccagattttactctgagtgatactaccccctggaagtggggggaaaaaaagaaggagggaaaaaagttaagttttcattctaaacatcttcaaagcttgattggctttaataaggtatcattaattaattcaacagctaagaagggactgcaagtgttaaaaatcacggctgtcaaatgttatggcatctgggagccctagtggttggttacttaacatgatattttaggacaattctactctgcttaagcataataaaccggaaagacatgaacaaatgtcccaactgcttccctttctactcccaccccctgctctggaaagaagccctaacacctctaataccacaccactctaaaataaacccaaatgttgcacttattttactgctatgcattgagcattattatttggagatgctctatgctgcttcattaaagatctttcatatggggtggggaaactgagccacaggggatgattaaaagaaggaagaagtcagatgacttcggattctgttggctcctgactagagaacaccttaggaaaagcaatccttcatctgcagcacacagaagaaaccacattccgaacttctcggtgatgagccccgtttcctaacagtgtgaggttaatgaacctccttatttttggcagggtgaggaagtggcaagcagaaaaacctatcaaagggagcccagttccaaggctttaattgcttaggtgactattaagaaaagagcccccttctttcacagcagaaggatacagttctctgttcccaaatctggcagctattcctcaattatagaaagaagaaggaaattaaaatgtgatggattaaataagagggtgaaccggtacttatttcctaactagaaattaccatttttgtgcttttaaattgataattatcagcaccatactttattcacttttgtcataaggtccttccttttaattaaaattgagatgcttcacatttcttgcgttcccttaagaaaatctttcaagtgtttaagtccctgatattggaaagctttaattacagcatagaaaaagaagagtggaaagagctggggcggggggatgtgtcccttcatttcccgtgaacatgatcacactgggaactcagggaggtccagtgcatttgtcaacttgccaaacattatgttcattaaaggccagaaagtatccctggggggtggatacacttgagctcatttccaatcattttacctgctctgcctcatttcagagcccagtcagatcattaccagacttcccacattgtcctaaaaaaatgcattaaaattaagtcacaacagacatccaggtttgcacctgtatctcacacctgtgaggatcgcttttatattgaaataagacaaggttctccagagaaacagaatatatatatatatatatatgtatgtattaccacacacgcatatatatatgtatgtatacatatatgtatatatacacgttttaaattttattaaaaattttaaatatatttattttaagaaattgtcttgtgtgattgtaggggccggcaagttcaaaatctgtaagtcaggtcagcaggctgaaaacttaggcagaagttaatgctactgtcttgaggcagaatttgttttttttgtttgtttgttttgttttttttttcaggaaacctcagtttttgctctgaaggccttcagctgactgaatgagggccatgcacatgatccagttatcaaggagaatctctttacttaaagtcagctgagtaaattgtctaaaaaatacctccacagcacctagatgagtttgatgacataactgtgtattgtatagcctagccaagttaatacataaaactcatcatcacaggcatcaagctcaaatgttagggtttgcagtggactaatgcatacttaagtacctagatgacacccagaagggacaaaagccctgagcttccccactcagcatgctgccacctccatacccatgttgactctctttctgttttcaggttgtaacccacgtattctggttctgacctgctctattttctctttatcctcctggagcaggagtgaagtagcaagtatgttgagtcataagacagatttcactattccttgaatgctgacagaactcagagtcttatgtctcatgattttccacttgatttccatttctatgctttgggtaatgaggtttaacttgcctctccattgggaatacagattcctggaaggtagagaatcttattttctgtgtatagagttcatagttaggtttcaggtgatattcagaaaatacattcagaattttagagatgtatggagttgtgaaactagcaaaatattaatcattcttttgacacagagcctcactttgtcacccaggctggagtgcagtagcatgatctccactcactgcaccctccgcctcccaggttcaagtgattctcctgcctcagcctcctgagtagctgggattatgggtgcctgccaccacgcttgaccaatttttgtatttgtagtagagatggggtttgccatgttggccaggctggtcttgaactcctgacctcaagtgatccactcaccttggcctccaaaagtgccgggattacaggcctgagccacaacactctgcctaatcattcattttaagtgattaaatcatccattcatctacttttagtacatcctacatcctttttccttccttccttccttccttccttcttttcatccatccgtccatccatcgattattaattcaataaatatttactgttttccttcttttgagaggtgtatgacctaaactaagaggtatggagtttaaatgacttgtggaaaattagaatgttttattctctcgtttcccacaagtcatttatatagttgctaaaatttagtaactgcaataaaaatacatgattccggacaacatattctcattttacttacttctaatattgatatcagattggttctcctgcctctgagtctcagttgagatcagaaagcggtgataacagctcattgggaattggccatttgcaaccaaagtttgtgatatagttgggacaactaactgaataactgggtcacaataggagacatcttaaattactaaagctacatgattttggaaagtctggtttcatttatttaactaaactaccagtaataccttatgtttccaactttggtttttgtcagttgagatctggcttaatatccctcatggaaaagatggacaatttaggcaaaaagtatttataaagataaagtttaggcagggcacagtggctcacgcctgtaatcccagcactttgggaggctgagtcaggcagttcacgaggtcaggagttcaagaccaatctggccaacatagtgaaaccccacctctactaaaaatacaaaaaattagctgggtgtggtggtgtgcacctgtaatcccagctactcgggaggctgaagcaggagaatcacgtgaacccaagaggcggagttacagtgagctgagatagcaccattgtactccagcccgggcaacagtgtgagactctgtctcaaaaaataaataaataaacaaacaaacaaagtttaaagaagaagtgtatatttatgtattatttaattaacacatgcaccaaccgtacaactgccttcagaaagtacctttctgacaaaattagaataaaggagacatagtgggtagggaggagaggggttaggtgggtaaatttaggctatgccaaataaaaatggggcccctaggagtggggtgcctaggactagcattggcagaaaccactggagcctcgagccagcatccttttgctgaggcctctgcatagttgatagagcagtcccaaagatgtaaatggagcaattagatatcattcaatttatagtgctcttggcaagaaaaagatctttcagaattcttcatctgccctaggcaaacctttagaggctctcctcttgcttattcacacttgtggcaattttccaagaagaaattccactaaaaagagtctattttttaatccaaattgagaaaatggggaagtagtctaggatgatggtaggagttgaaattctggtgtcagactgccagagtgcaaaaacctggcccaggcctccctcctatctactaagcaggaagggggaggatgtgaagaggtggtggttgggggttggtttaccttggctaagctgctcctctaagcttccacattcccacttgtaaaatagagtaataacagtccttacttggcaaagtggttagaaggactagatgagccacttctgaagaagtgctcagtgcatagtaagcaagagaaatgataactgttgttcacatgtgtacagtgaatgggactattacatgaccatcacatcaatgataattacatttccattatttttccttttaactcataatacctttgggtatttagctggaatgcagcatattttactaaatggatacagtagaatgctccatttaataatgatatctactttgttttcttgtcctcaaatcaaagggacccgagtgcagtggtccagctattcaggaggctgaggtaggaggatagtttgagcccaggaatttgaggttagcctgggcaatatagcaagaccctatctctaaaaaaaatcaaatggagaaaactattggtccatattctatgttatagacaagatacaaaagacaaactcagattaatgcaagttaaccaactctataaaaattcatagaattttattattatttaaactgccttttctaccactgctatatttgttgactctgcctaggcatgctttaaaaattccataaacagctcacgcctgtaatcccagcattttgggaggccgaggtgggcggatcacgaggtcaggagatcgagaccacggtgaaactgcgtctctactaaaaatacaaaaataagccaggcgtggtggcaggcacctgtagtttcagctactcaggaggctgaggcaggagaatggtgtgaatccaggaggcggagcttgcagtgagccgagatcgcgccactgcactccagcttgggcgacagagtgagactccgtctcaaaaaaaaaaaaaaaaattccataaacatgtaaaagtatattcattactagatatccatcaacattgggagagaatctaaagcaacttatcccccattcttttacccagctgtattttctgctaagccacctatctcaatctgagattatattacacatttaaaattttctggtttatcatcccttcctaaaatgcatacctgaggagggtggggactcatttggtcttgcttaccagtgagcctctggtggactgataacactccataaatacatgtagaatgaatgtcaagtaaataaattcagaaaatgggcatttatgtttctaagttgaatatgtattcacaatttcagttaatacccacttgcttttattatttatcttgtgagatatgacatttccaatgcaagccttgccctactgaaaccatcatttgctgaatgtgtaattttcatcaaactgtactttaatattaatcaaaatgaaaagaatcctcttctaaatatttgttgaccttgagcttatatcatgtttgcataatgagatttaagtagaacatactttaaggtgcaaagagatattttttcatattctgtgttacaaacaagacacaatagataaactcagattaatccaagaaacaaaaataaaaaaatgaaagatcaagaaaaagctgttttttttaaaagattaacaaaatgcacaagcccttggtgtgattatcccagaaaaaaaataggacataaagaaataatattaagaatgaaaaaagttatctaatacaggattagtaaagatttttaatatcacaagagaacataattttgataaatttaaatcttagtttagacaattttctagcaattataattttacaaaactaactcaagaagaaataaaaatgtgaataaactactaattgtcaaaatattatatacaaactcgttctaagcctagaaaaaaaactgggagaagtcctcaacttattctatatggttaatataacctagataccaaagtttaaatctctttttttgaattatatgaattttatgaaaaattctaaataaagcattcataaattgaatattttaaaaccccagatacatcatgactcagggatgaggcttgacttgacacagaagaatctactaatgcaattcactacattaatagagaaatgtagagacaccatatgatcacctcaaaaagtgccaaaaaggcaataaaattcaatagttatggcttgtaaaaaccggaagtaaactaaaaacagatggagactttttcatctgataaaggatatccaccaaaaacaaaaataaaaacaaacataaaacaagtaaacacctacaaatctactgtgaatttctccctctgtggctacagatgagtaagtgcagggtctttggcagctaatagatctggaggagcccttgtccttttataggacttagaactttaagtacaaaagttccaaataagtttgacggaacaaataggcaccagcttgggcaaaaaaaaaaaaaaaacaaagctgagccttcatcacaaccatcttggattactgagcaggaatcctatacaagataatttttttaaaaagataaaacaacaactcatataatgtttaaataaacacatattaaagatttagcccattcgttaatgagggaaccaagatcttacagtcaattcaaagaagaattcaaaacacataggcacacacatacgaaataagaaatgctgaaataaatttataaataaatgcaaaattagtcaatatttccagggcaattgtgaactacatctccactgggtacaatttgtttgagtttttatcggcaggaaccagttggatgacagtttttgtggaggtgtgaagtagctcaaagacaacaaaaggcagagcccatgcagaaggtaccaccccaccatccgcttgcccattttaacatctttcacaatttctgttaacagtttaaattatattttgatgttgatctcttttaaatacttgattagggaataattttctttattctctgatgttgctgacgcttggcttaataaagagtttttattttcttatttctctttaaaacgtgaaatcagtggagccatatgccagtgtcagttagatatgtctatggaaagtcagaccacactcctgttgggccccagctggcttacctcaattgctagcaaaatgcttgcaaggaaaatgtggagacagcctaagctacagaaaccatcttgctttttttctgataacataagttttcaaagcaatatttaaacaaaagacaacatgttttttccccaagtaaatatctacagccttcctcccagcctgtcttactcccaaatcatgtccttgttatttgcaggtatccaaatgtctgcatgtgggagcattccttgtggattagggtgttagtgtctaggagtctcctcttttatgaaatgcaaacattctttgagcacaattgcaacatcagctgtgatatttacctaaatgtttcccaaggataagtggcttacgtcagagccctgaggctacaggatgtagggtttgaccagcaagagatttgagggcaggtaggtatcccatgagaaaaaaagtatcagagacacaacagcattatcccaggacatgaggtcctggaggttagaggcagcccacaagaaagcagtgatcccaaaaagagacaggaaggtgctaacgacaaaactcatctttgtgtctactcccaggctgatccgtgattaccaaaatgatccagtccacaatttccaatgctgaagacagaggaaagatttggggctgagagtgatctatgttgtttgtttatatacaagacattaggtaccctgggccattgacctcatagagaacaggcagcatttgttgtctgccaactctggattctgcaggcatcaaaggattagactctcataatgaaatcagccctttaagctactcggaagacttacgatagggatcactacccagattaatttgctaccaaatagagaatgagaggccaagataaacaaaagagagcagccagctggtagggtttgaaaaaaaaaatgcaagccattcattttccttttgttcttgtatttccaattgaattatgatggctcatcttttctaacctgatatgagctgaattttttatgatttaaatttgctcattatatttctattgcagagtggttctctgaagaacgagcctgttgctggctgtcagggtgtcatgatggtattgcgcaaatcctcgaggcagctttccagggctgctgtcagcctgctcatgccctttagccactgggcagtaaatgaggatctctaggactgaatacataatttgagggggttctgtgcaaaatgaaaatgcaaggtaccttgtaaaaaataagactttcatcagagcaacagggagcttctgggtccaggcctcaggccacacacccatgaagttgaccctgggggtctcagtgatgggataagcaaatcctttcccacagcaattacataaactgtcttgccagggactgaaggcttacaacttgggagtcagatacactttgtagctcagaaagctgactttaataaaagtagtgtacctagaagacagctgtttatttgtagaggtggcttgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattgtaagttccctgaggcctccccagccatgcttcttatacagcctgtggaactgtgaatcaactaaacctcttttctttataaattacctagtccctgttagttctttatagcaatgcgagaatggactaatacatggctttaccttagatttcttggaatctgtaagttgatccaaattgcttgatgaatgtattctctagggatccatgtgaatctctctttgagaagatttttctcttgtggcttcacttagagtctatctacctttacataggtgcatttatattgaggtgattgattatttgggtaacagctccatgtatactatgatagttataggggccccatttgtattagggtttgtaattctgtcagcatgaagcaatcatttcaacggacaatatttaatttttaatgtaggatttatctaaccaggttctgcagaggtgttcttggggtgctccagtgctcaagttaggaaaacgctgctttaggtctaagtcaggttcgaatcaaaggttttgaggtcttagtgattaataagttctgtgccccttctaatgacggtatgtaagtccaaatgccatatgcaaatcaaatctttgaaggaattgatagaaaatggcaatcttcattcagataagatttagcctagtggttaaaaaaaaattccaaataaccaaatattgaggaataataatgtagcaacaacaacagttttgagtactcacagcatgacagatacttttggtgtatttttccagtcctgtgagataggtccttgttgatcctccattttgcagatgagaaaaatgaagcaagaaggattcagtaactcacccacgtctccaggcagcaggaggcagaagtcaaatttaattccccagaatctgactctaaagcaagtgctttaccctctcaatttcatttctctacacacttgtgctggaaaatgcatgaaagtttgcatgatttcacactttcacatgagcatgaagatcagaatttatggggatatgattgttttaaattgtaggttttattattattcaggcatagtgagttcagcagatcaggagatgactgccattgaaaggatggtttattactcacagttcccaagagcaggaggcagccacaccatacagggccttttggggaagtgccaggattggtcaggaagcagaggggctgggaggaaaacatggacaagagcatttattacagtttctgtgagaaggaacaggtgaggcaggatagacagacttaggattgtctggtttaataattccaaagggctctgggctgcaggggctgtctctcattgcctggtacctggccatgggatgatttgggcaggtgaatggtgggggaggcttgtgagaatctgataaagaaggtctttggggcatgggctctgggttagttggtttgcatctggaagacacccttgtaggcaaataatttactatctttagaaattggctatccctgggaggggcagtctctccagggtcagcaaggccccagatgtcaaagcttcagaattagaagatatgcttaatgcattgacctggaagacctgggctgacaagagggacagggactgctgcctggtctaaagagtcacctcttaggaccagtgtcctcccctttgttaaaagaagacaaagagtccttgaagagtgatcataaaaagatgatgccaaagtgtcttggggagacagccacatttttcagagctgtagccacatgtctcaaagatgtagacttgtgggtaaatggtacttgaagcagaaagcaaatgtgacacttagtgattgtaagtaatcaagatgacacttcttggtaattaggcagagacgataagtaattttttaaaagtttcagatgcctattgcttttgattttctctcctctctttgttagtctcctaatgtcaataagtagaattcatgccaatgacacctaacatcagtcctttctccctggcccagcaaataaacaaaaacacagaggaggctgcctggagaactgagtgttgcctctcacctgcagcacacaggacaagctgggttcttcgggctccacattagaggtctctttcaaccagtacccagatcccagcccaccttctcttggctgagttctggagcagacttccaagtgctcttttatttctgtttggaatctgggagtcttggtggttgaagacataaggcaccaagatatctgggcttggaggggaggattctagagttctaagcaggggcactaagctctagcattgagaagtagaaatggaagagaggagagggacgagtattgtgaacaaaaagttggggtggctgggttttgtacacccagaggttctcaatgaatgagtctccatcagcccctgaggcttcctctctctcaaggggcaggagaatacctggaggaagtggggtaaagaggtcatggagattagcagtttttcaccctttgaaagtgttaggccatgtgatggagcctccagacccagaatctcatttagtccttatacaacctgaaaaagtcttccaaaaccttaggggcaaacacatcccatctctttcatttttccccccaatgaaaatgggtttatcctttaagggcactcttatttggaggtccagtactcccccctttgatgttctctcctcctcaaattgtccacaaacctagagggctgatgtggtccaaatggacccaggtttaatcaaactgtctccccaatgaaagctaagcttcagttggtgctcgctgccacatggcttgagctgagtgctggtcctttccacctgaaagatactgccgggcagctgctgacccaagctctttcccaagacattgtgtttttttaagagtggccaatgatactcacttggagctaaactcagctaataggatgccatgatctgagggcctctgcctttagagctcaaccactagaacaaaaggtctctccctaccccctccttctaagggtggactccttgctactagcagggagccagacagtcttcttagacgttcccctgaaagtaaagctgctacctgctcacccttaggcagctacacctgattccaagctctttcagtatcttgaaattgctcgattctctttctttttcgtttctcaatatattttatttttagagcagtttatgttcacagcaaaattgagaagaaagtacagaaagtttccacacacccccagtctccatacatgatggcatcaccctagtcagcagtccacaccagagtggtacatttgttacaaatgatgaatccgcactgacaacttataatcacccaaagcccatagtctaagttagggtcactctcagtgccatatattttatgtgatttgactatatgtaatgacaggtatccacagagatacctgtatgacagagtgccatgcagaacagtttcactgcactgaaaatcctctgggatcctcccattaatcactccctcccaccaacctcttttcattgtttccatagttgtgcccttttacagaatgccagaccattataacaacacagtatggagcctttttagattggcatctttctgagttttggaaattatgtaaaaacctgctctacatgtccctgagaaggttttgattggatataagttttcaactcgcttgtgaaaataccaagaagtatccttgatgaattgtatggtaggaatctgtttagttttgtaagtaacagccaaattgtcttctgaagtgctagtaatatttttcataatcaccagcaatgaatgagagttcctgctgccccacatcctcaccagcatttggtgttgtcagggttttatatcttgtctgttctaataaaagtgtagtgccatctcattgttgctttgacttgcagtttcctgatgacatatgatgttgagagttttttcatatgctcatttgccatatttatatcttttttgacagagtgtctgttcaggccttttgcccattctttaataggttgttcatttttttgttgttgttgagttgcaagtattctttgaatatcttgaataatatttctttccagatatgtactatgaaaatatttttcttccagtccatggcttgtcttctcattctcttgacaatgtctctcacagaattttgggtcttttttgtttgtttttaaatttcaatgaaggtcagcatattaccactgtattcatggtgaattagattttctcctgtcttcttctaggggttttatagttttgtgtttacatttaggtctgtgacccattatgagttaatttttgaaaggggtgtaagggctaggcctatagtcattttttttttcctgcatgtggatgtttagttgttacagcaccatttcttgaacagattatcttttctccattgtactgcctttgattctttgtaaaaaatcatcagttaactatatttgtgtagatctatatctgaggtctgtattttgttcctttgatctatttgcctattgttttgccaatacaacactctcctgatgattatggcattgtaataagtatggaaggtgaataatatcagtcctttcactctattattctttaatattgtattgattattttgagtctttttatcctcatataaactttagaagcagtttatcaaaatccacaaaataatttcctggggtttagattgggattgtgttgagtctataggtcaacttggacaaaagtagcatcttgacaatattgagtctttatagaaataaaaataaaatatttctccatttatttagctgtttgatttctttcatcagaattttgttgttttcgtcttgtacttattttgttagatttataagtatctcatttcagaaagtgctaattttaatggaaaacaatttatttttaattaaaattcatttttaattataatttaatttataggaaaacagtttaattttgttaaccttatatcctgtaccttattataatcactagtttcagaaattatttttggttattttggattttctacatagacaacactgtcatttgtgaaaaagagcagcctatttcattcttcacaagcaatatatccgcttttctcatattactgcattaagactcccagtaaaatgttgagaaggggtgctgatagagaacatccttgccttggtctcgacgttagcagggtaatttctagtttctcaccatgttggttatgatggtagctctacattttttaataatattcattatcaagttaaggaaattctcctgtattattgagctggtttttaccatgaaagggtattcgattttctcaagtgctttcctttctattgatagggtcatgctatttttcttcttcatatataggatggattgcattactttctttttatttgttcatttatttattttcttttcaacttattttaggttgaaagggcacatgtaacaggtttgttacatgggtaaattgtgtgtcatgggggctttgtgtacagataattttgtcacccaggtgatcggcctaatacctgatagatagtttttcaatcctcaccatcctcccactctcaacggtggactggataaagaaaatgtggtacatatacaccatggaatactatacagttgttacaaaatgagatcatgtcctttgcagcaacgtagatcgagttggaggtcataatgctaagtgaattaatgcaggaatagaaactaaataaatacttcatgctctcacttataagtgggagctaaacagtaagtacacagggacacaaagaagggaacgatagacactggggtctactctcttaagaaaaggcaagatgacattccagtgtccacctggctagaacagaaaaaggaaaaaaaaaaaaaaaagaacattgactcattcccagggcatcttcctacacttagattctgaaagatagtattctttccatcactcctttcctttctactcttagcacaaatatccttaaacagaattttagagccgaagtcaaagtcactttgttccacatacataccccaacatctgctacttgttctcttgatacttaaattcacttaacaggagatctggccttttttccccaagctttaattaatggttaaatcttctgaaaggctagcagaagtaatctgttagtgcaattgggtttcactcctaattcttagtgtcattctacagttctttctcaagccgtgacctgtgatcaccatgatcagggattggcaaactacagctcatgggtcaaactcagtgagctgcttgttttgtacgagctgtgagtgtccacaaaagttttattgaaacatagccatgcttcttcgttgtccctattttcaaagaccagttttgttctatgacagcagagttgagtagttgcgacagagactgtatttcctgcaaaatctaaaatatttactctctgactctttaccaaaaaaacccccaaaaaacaaaaaaaaaattgctaactcctggtctaggtagtgtgaggttcagtttctggctccagcactcactattggggaggcattaagccagtgccattctcctaggaagtgctccacatagcagctattggcacacaagtcatgtggagatggggaatcctaaggaaaagaacgatcgactttggataaacttattgaacttttaaattctgacagtatcctgcttatataatttctgcacatatggaatctgcatcctgagtttttttctatccagttcatgtttgtacaagtatcttatatgtgcagatgatgaaacagtgcctttaagcaaatgcctttaagcaatgcctttaaacaatgccttgagcaaaatgatgtatttgagtgagtttattgtcagtattaccaagcacaatgtttgactcctgctttggtaatgtcaggaagtgtggcagatggtggggagacaagaggagtcattcaggaagaagccaggagctcccaggataaaagaagcaattaaaatgcaacccttggatgggctcaaatgcagtctgcctcctcttccttatcacgggccagatccagtctttcttaattgaaggggtcaagctaaagttcttatcaacaaaagtgatgttgcttaggaaagtcatattccttagctaattttaggtgctgttttgtgcttcctgtgttaccaaccttctaaacagtaaataagagaacattgctgtctataaaaaaatcttttagttgtagtgtcaacttacaaaagaattgacaaaaaggagtggaagttcttttaagtccttgccaggctgcagagcagagctagaagaacataaagtcttaatcctttccctgctctttaccttgggggtggtggatgtttttcagggctctgtgggggactggcgtggtgtttggtcatgctgactggggagccagatgatctatctgagctctggtgttggctttgccatgtattctgaaccgtcgaatcaacccctattccaggatggttgattttatgtgtcaacttggagacattttgggatgaaattaacgtttaaattgatacactaagtaaagtgcattgctcttcataatgtggatgggcttcatctaatcagttgaaggcctgagtacaacaaaaagaccagcttccccgagcaagaggaaattcttcagcaattgccttcaagagttcatctgcaccattggctctcctggtctccagcctgctggtccacactgggacttggacttgccagcctcaataatcatatgagccaattctttataataaatttatttaaatacacacacacacgcacacacacacacacacacacacatgcgcatttgatttctctggagaatcctgacaaatttaattctatgaatagagtaaaagtctctgttaacttataataaagttcctgttcattttaaaataaaaaaaggtactattggctcctggttgagtccttgaccatcatatgcacacatgctttaaccccagacagacagcttcattcttctttcttgcacaggcaaaacggcttctcatctttggagtagtcgagagtctaggtgctggatccagactccctaggttcaaatccgagctctatcacttggtagctttgtgaccttgggtaaaccacttacttactctaggcctcaattccctcatctgtaaaatggcaaaataagaatactcaccacataggattattgtgaaaagtaatgacttaatgcaagtaaagcgcttaacaaattatctggcactcagtaaatgcttgtcccacttagaatagacctggtttgtctgcagtgatgaaacatcagtctgctgagaacttggctagaaatgcttaagtagttgagtggagccttaaaagaagcaagtaaaaaaaaaaaattctgctatgtgcctgaaggagggagaaatgaaatccttggcaaatagaatgaataatttccccagttactattattaatatgtattatgtggctagcttcaccttgttttcttgctcagggaaaataatttctttgaatattagattgatgcttctatcaaaaagcatcttctctgtcctgtttaacagagaaaacatggttcccctcctccagtagttaaagccctgagctgtgtcctccagtgcccaagcagatagcatttagtatcttgggctgttatcaaggagcttctttatagaaggaattacaccttcggtggttgggggtgggggaaatagttaaaatgcaaatgtatcagtatttactagcttttggagctcacgtctcgcgcatttcattctgaactttttgctcaatgcctctgaaatcacccttgctaatttaggcccctcggaaataattccaccaaggcagaaaattggcaaccaaagaagtttcactggcctttagatcattttctttcttaacttgtaattttccgttgctttctgttctccattaacttttcatttgtccattatattacatgtgtagtggcaaccttgattttgatacatgatgtatattcactgagcaagggggttgatccattatgtggaccccttctgggaatatgtggactgtgtctatcaatttaagaatgttatatatggaaacataatgagtattataaataagttttaaaaacctatgcacacagataatgaacttcagggacattttaaatgaattttccttgtttttagctgaatacccaataagagtctaggtatattataggtgagtgatctgtgcccttgataaccttgaaatttggaatttttgtactgaataagattcatgctaagcatttaagggcagtctgttggattcatggcaagtgttatctattggattcataagatggatcttggagaactttttataaatagataatcccatgtgctatacctgtgagattcctagagcatagagataatcgctctttcaccattgccatttataaatgtgaaaaaagtctgaaaactcagtgaggagccttaaagaatgtctaggcacccaactcttgatgcatacaagctacccagtgtaagaatgtgcatcttatgaatactgaatattcagcattggttgaaaggtgtgtgggataatcgtgtgatagtgggaggaggatggcctttattatttgtaaatatgatatttaatgcaacccaagttttaattttaagccatttctcattagtgcatcttcatatgaaatttgaatagtatgaaatcaattatgcagaggaaaagtacttgactattgataggaagaaggaatgctgtattaggagtcaggagacatagctcagtacttactcagtatgtgactttcaacaaacaattgttcccctctaagcctcagtctcctgagttgtaaaatgaaagaatgacactggatcctgtttctaggttcctttgcactttcaaaatctttaagaatcttttgttgttgttgacaaaaggatttaaagagtagggacaagtgaccatccataagtgatgaaaagaaaagttaacccaagagatacataaagtggggaagcagcagagttacagttggagaaaccagggagtgaagtcgaggtgtgccacattccctctagatgactcttgaagggttgggtttctcttctgtaaaacagagaccatagctcagaggtttgttataaggattaaatgagataatgcataaaacatgcttccaggaataaagaatcatggaagtgaataaggaagaaaggagatggaggaagaggaggaagagaaaatgacttagaaaatgtgtgattaactaagtaattaatccttctaaaactttcacattcagccaaagcacatttgtgcatacaactctcatttgtctaccttggaataatcaattttgtgagttattcacagaagatgagtgaactcagccaggttttctaatactctgctaccttcttgttcacctattttctgactaggaggcatgtaactcaagttttcatcagcctaagcccaaccacattttggagacatgtctgcatcacaaattatcttgggctttcaaaaatcaaaaataaaccactttaccaaaaatcaatcccactccatcactttggtttctctgtgccttgtgcgccattattggcatgaggagttgtgagctaaccgtgccacattttcaggagcctttgtgccatcctgtttcagcccttgacaggtgctcctgcggggttctcaagctttccttttgatttccccaggatattatcattgtggctggtcaagggaggggacatcctgagaaaatcagccaacagttcctcctggaaaatccaagctctctgattagaggggcaagaaatccaactgatatgtatttaagcacttttatagaattcccgctatgtgccaggtgcacatagttcctaggtaataggatgcagcagccaactagctgaccaagtcctcttgaagctaacattttagtggagaatgtagataacccctcaaaaaattaataaagaagaaataaaatttttgataatgggatgtattatgaagaaaaataaaagcaggggaaggggcagtgaaagtgatggggtggtctggaaaggtcgatctgaggaggtgatttttgagatctgaatgcagtgggagaacaagccatggggaggaatagagaaaaagcaatggaggcacagaaaatattaaatacacagtgggtggaaacaaacaattaacttggccagtgcagctggaacagggtaatggttgaaggacggagcccattcaggtaggcaaaggttggagtttcaagaccttgtcagctaaagtaaggggtttggatcttatcagaattgagatggtaatctattgaatggttttgagttggagaatgatgcaacttatttgcatattaaaaagattactctgactaacatattgataacagactgtcatgagaccagagtggaagctggttagtagatgactgaaactgtttaggagagagaagaccgtgcatttcactagagtagttatagcaggggtagtgtagaataatgggattcagtacatattttggagaaaaatccagcctgacttttcgctgtgtttatgtgggacgtaaagggaaagaaggagtcaaggataactgctaggtttctgtttttagcgactgggtaaatggtggtggtgttaactgaggagatgaggtgctgtatcagtgaggactcatgcaggaaaaaaggaaccactccaggtgtattaagtatgaagtggtttaataaagggaatcgagtgctttcaaaagcattggattagctgaggaaacacaagttagagaaggtgcccggtagtatttagttctgctgtcactgcttgggccagtgaattcagaagttgttgctaccactcagatgaggaaagtaaaggaaaactagtgctgccctacagcactgagaagagtaactggaatggatcacccagaagccaccgcaaaaactcttgtctgccaaagctttcgtgtcctacattgatgcatggggaagaagagtatgttctgtgctctttcatctttgaaatctctcactagtgcacctcattagcagaatatagctgcaaccagaaactgaaaggcagaagaatctgacagataaagtttccagcctttcagctggcattgcaaaagaaagcatataacacaggacagaggagagcaatagaatcttgtaggctaagggacagataataaaatatttgtattgttatgtcataaatctgtgtgtctatcggacatccaagcagaagtgtcaagtaggaagtagaatacacaagtccaggaatcatgggaaaggtcaaggatggaaatataaattggggagccattagaacataaatggtaattaaaggcatgcaagtggagagtattacctaaggagtaagtgtagatagagaaaggtcttagaactgagctccatatgcttcgggaaaaacttggacattggggaaattaggaagcacttctagggttaaaaggactgaaggccgtgcacggtggctcacacctgtaatcccagcactttgggagcctgaggcgggtggattactggagatcaggagttcaagatcagcctgaccaaaatggtgaaaccccgtctctactaaaaatacaaaattaggcagtcatggtggcatacacctataatccctgttacttgggaggctgaggcaggagaatgacttgaacccgggaggcggaggttgcagtgagccgagatcgtgccattgcactccagcctgggcaaaaagaacaaaactccatctgaaaaaaaaaaaaaaaaagacaagttgggactgggacctgaaagaagctcagacaaatggcttacatattgcagtcaagactacaagagggcttagaggtcaggaagaagaggagatgccagtcaatgcgactgacaaggtgggagagcagtctacagagtatggtcctctgaaagtcaaatgtcaaatactgatgagagttatgttttgttttgcttttgtttttgcttttgtttttgttttgagacagtctctttctgtcacctaggctggagtgcagtggttcaatcacggatcactgcagcctccacctcccagttcaagaaattctcatgtctcagcctcctgagcagctaggattacaggtatgttccaccgtgcctggcctgatgagagtttttgttttttaaattaaattaaattaaattttacgttctgggatacatgtgcaggaagtgcgggtttgttacataggtaaacgtgtgccatggtggtttgctacacctatcaacccatcacctagggattaagcccagcatgcattagctatttatcctgatgctctccctcgtttcagcccctcgctgacagaccccagtgtgtgttgttcccctccctgcatccatgtattctcattgtttagctgccacttgtaagtgagaacatatggtgtttggtttcctgttcctgtattagtttgctgaggatgatggcgtccagctccatccatgtccctgcaagggacatgatctcgttcctttatatggcttcataatattccatggtgtatatgtaccacactttctttatccagtctatcactgatgggcatttgggttgattccatgtctttgctattgtgaatagtgctgcagtgaacatacgcatgcatgtatctttataatagaataatttctattcctttgggtatatactcagtaatgggattgctgggtcaaatggtatctctggttctagttcttggaggaattgccacactgtcttccacaatggttgaactgatttacattcccaccaacagtgtaaaagcattcctgtttctccacagccttgccagcatctgttgtttcttgactttttaataatcgccattctgactggcgtgagatggtatctcattgtggttttgatttgcatgtctctaatgctcagtgatgagagttttaagaagatggagtatgagagttcaacactgtatttggccagatggaagccgtaggaaaccttaagcagagtagtcttcaaaatcttgaatgaagtggatggaggtggggatagagaatgtgcagtgagcaaataaagagagaatttacacaattctttggactcattgtgatgtaatataaagagagcagaaaaaaagagcagcagttggaaatgatgtagaatctggggagagaccttttaaagaaaggtgatatcaaggcttgtttgtggactgagaatgatgtgtgatcttggaagtcagcttgagaatggagcagtcaagacacaaattggttggcaggtcatgatcagcatgagaggaatctctatcctgcttccaggctatccttggcactgtgatttttaataaaataatgcactgactttgcattcaaagaaattactggacagtcaaaatatacacacatatgcaaaaattgaggagcaatttcccataagatgtaagcaagagtaatagttattttatgttatttctgtaagtgttagtggcagtaagtaaagaatgaattgtaaaattgtgacagggaaggtagaggagtgctttttgaaacctattttccattagatcttaaagaaagttgagaacataaatttgtggagaagtgagggtgaagattcttaagggaggcagaagcaagatttaataacaatgcagaacaaggaatcagcaaaacctgttgaaaacgtcagaaaacttaggggaagctggagcagagggttagagttgggagacctgagtgagggtcttggctttcactcagtgtgcagtcaggatccacctaatgtggaataaccatggggttctggaatgggctgagacagtgacatatttgcccatattagtggatccatgaatcattttctacaaagtcttcttgttttgtttttcagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcactgcacaaacatctttcctgtgtgctaggcatttccaaaagcagaatcattctgtatctgatttgcatcatcttatttaaaccaagacagtattggccatactgtctaccaaaacaggctgtaagaaattacaataatttttgcagctatagggtaacaatctatctcttatgggtttccagaaagtgttctgctctatatgattttaagaaaactgggacattggtgggaggatagtagttgggaaatgcttctaggattaagaggattgaagttgagactggaggtaagcttaaaggaatggctgaagtatcccatcaagacatcatagtgtcattataatgaccatgttctcttgtgaatcctcaccaatggtatagaatcctttgatttcaatttctaccactctgggaaacccctaggcttgtgctcctggtacatcagcccatttcatggtacgttgaagcatgcctccctgtgggattgctggattcccagcccagtgaggtaatgaccaagcagcgtcttcagaggaaggatagctgtacagcgtggtgaaggactcaatgagaaggtaattgatgcttcaccttttcttattttctgtaaagtaggggaatatgagtcctccactgtgtgcttttttgtttgtttgtttgcaagcaatcaaaattctttaagcttcttggaggatgggattttctagaaactgaaatttttaggggtggttggggtctaagcaatccagagaaatatgaatgcaacctcaggggaaaagatgaaaggtgctaaggaggaggcagaatagtcctataaagaaaaggcacacacatacatgcacacacacactgagactcacacgtatcttgttaaaaacattacagcaaactggagttcttaaatccccagtgcatagagctttgggagggtaattctgttaacttaaagggtagtcctctgtaatgaatgcagttcttgtgcatactcagctactgtgctctaataatgtcttactgagcttgaggatctgtcaggcaaaatatgctgatcttctgtaccctgggaactttctccaagtgaggtcacactgctgcccagctcagttctaggaccgctctggtgatgcgattttattccatgtccggcgatttagaaaacacagagttttgagtttgggttccttctaatgaatccattagtggttgtggtgggtttcattgatttcttcctgatgatttgtcttctctttaaaactggtgctatttgtggtttagtgatatgtacttgtaaggatttgggtctgatgtttggtccatcagccagatcatctgcagtttgggattcttggtaatctaagacccaatgtctgaccccttctgacctcattctgtacatgctgtttagttacagtatgagcttgttccttaaacgttccaacagccactgggctttcaacaaatgtaactgaatgaaagacaaatctttcctgtgcagatttgcctgtctaaaacacagagttaaaaacacctctcattacctccttataattatatgcttggcctcctttgaagccaaggtatggcttttcaagccagttgccctgtgacgtgagagggcagcacctttctgaagacggttctcactactgctacaccttgtgctgctgaaagcagcaggagctctgcaggtgaatgtgatttctctgtagctgcccaaggcagggccctgtatcctatggttgctcagggggactcttgggcagaagatgcctgcagatcagctttgtagtgacctccaccatcctggtctcagccatttttccttggcaccatccaggccgagcttattgcagcgaggaccaagatgtcctcatcctcaagcatgcctcatgcaaatagagtgaagccggctcatttccagcattttctttctgacattaaatgtttttctggcagtaggtttaatattactctaggcaaaaccctagggttttacacaaatcatttatcatttggacgtaattctcactatttaagcacctccagtttctacgttattgaatgagacactgtggccctcacccttccatcaggatggattgggtgaagggtcttatctaaaattcccagtgtgctctaattgtcaatcaacaattcaaattaaacaagtgacctccactacctacaggatagacttggtgcaagtctagttttagtgtgaaaagcaatttccatatagacatagaccataaaggggggctcctgtaagggtctgaacaataggtcattgtatgtgactagaaaagtggggagaaaaaaacagagaaatctccctacgggtgcagcgtttttggttttatagaaagagagaaaaacaactctttttgaatcaaatcatcaggcacaaaaaacaaatgctgccagagtaattatccctggaaaaactcagtcctgagggctctccacgccataggcttcctgatgccacctgcagctcatcccaagaaagggttggagatgcatcagcagccttcggcaaaggggaaacaccgtgcagcagggctgacttggcaaagaggcacccccagaggaatgcgaggtgcagcttctctccctttccttcttgccatgtgctgagagcccatgaccccaggatctttctgcagtccttcccctcaggttgcttagacaaggaacttaactgcacttcaactactgaacagtagaatggggtcctaattgtaaccctgtcatggattttgaaggatttaatgagacaatcaatgggaaatgcttggcacacagtatgcccccaagtcagtgaagttgcttccattcccaacctcggtcttcagtccctggtcatctcacaagcaactaaggactcaacattaattcaagggacagatctgattggaggggcctccaagatgagggaaggtcctctcggccactagggggcactaactacatggaaaacaagcactgaatttcggggacttgctccactgccctgcaatgtaaatcctgtaactcatttaattttcttggagcaaagtttgggaatggttgatacagatggtgctatttctgcttgggaaggtggttacacttacatgtcaaatgaagaaacttttcttagctcctccctgtgactcaccagctccagctattatgaactcatactttaaaatatttttttctattcagccccatttactttcagtcctctttcttctgtattctccaattcctggaaaaatagacaatatccttagttgtgtggaagaggaagaagagttatgtagaagaaagaagcatccttactgtaaaatgtttctgactttttgagccaaccacgtctggatcagatgtttccatctagagtcataccttttcatagccttttaaacctggctcatgagaggaaagagagagtgcaatgtccctgagatatctaggaaaccatggagaatttcttatcagaattaacccctattgttttgaaagtaactagatcctaggaagcatgagatgccacgggcttcccagaacccatagcaggtgagaaagaactggaatacagggtgaggtgtgatgaatcgaactgcttttcccagaacacagaatacagccaaggtatgaaagctgttccccagaggggaaaaatgtacactggccaatgagggtgcatccaagagcctgtaggctttcttgggcattgattaaaccaatatgccaggcatcacctgcttgagaattactagagatgtttgtcaaacccccagtccctggaattagactaccttgatgtacatctcagaaatatgcaactactttgaggtggttttacatttcctaaaatttaagaacaattgctctagaagataataattctacctccactgacactggaaatacatgtaaggatggctctgcatgtccttcatcacagcaagttgacattttctagaatcactgaaaggaattattgctataaaaaaatccaatccaacaataaagccccagatgatcagaattgttcatcccgaaactcttcatgtcccagaattgcacatggtgtctgggacacttgctggagtggattcctgtgatcggtgacctcccagtttgtgtgccgacagggcttagagctgcaggcaatgcagttgctacacggtatctcagtgtcaagaatcaacagttccatggagccaagagggtgcaggttggcagtggttgggtggggggatctgtttgcaagacggtgtcatggagcctttctgtggcattgaaggaacaaagatacaggggcacaaaggacatggcactttgtgctgctggcactgtttctacattgagtgacctccccaggaaatccccactgaaacacaaggtgagttttgccagatttaaacaagataattccagtgagtttatcaggaagtggaaatggagagctacattggaaatctgttttcagacatcccgtgtccatttctgtttctggaaaccacttctagatgaaccttggactcagttcatcttccctttgctctacattctctgatttccaagcaataaaaccaacagggctgtatttctctggacaagaccctcacctatcagcagaaacagaaaagcaaatcctccccgaaacagcagcttggggaagtggcccattggatgcctttttctagggctgtactgtgagaaaatgtctttcattgcatctgcccaatgctcaaagttacttctcattgagaagaaatcatagatttgacaaaattgtgagtgaacactaaagaacctgtcttctggaacgtacctgtgaggtgaaaggaaaggaacttatgtttggtgtgtggactggtgggatgcaggacaggcttcatcagggtgtgacttgtgccactgcacaggggcccatgctcagaagagctttgcacttggtttaatgccctgatggcaccatcctgaaattcttttttcttttttgttttttgagatagagtctcattctgtcgcccaggctggagtgcaatggtgcagtcttggctcactgcaacctccgcctcctgggttcaagcgattctcctgcctcagcctctggacttgctgggactacaggcctgcatcatcatgcccagctagttttagtatttttagtagagatggggttttgccatgttgctcaggctggtctcaaactcctgacctcaagtgatccgcctgccttggcctcccaaagtgctgggattacaggtatgagccactgcgcccagctggccatcctgaaattcttaatactgtgtaaacaagggtcctgaattttcattttgtcctgggctccacaaattacacagcttgtcctggtaggactgcatggtgggatttggagagctctggatttaaaattaggcagtcttggatcagatcccgctcttctacttagtaactgtcatcttagacaagtgatagcatcctccctcccagcctgagttctctcatctacaaaacagaattacaaacagaatcccacctttctggtgggattgttgttaatactgagtgagttcacctggcatatacagctagccttgaccctggcatgaagtcagtaaatgcagataatttgtactcaatttaagtaaattgtatgtcgttcttgaaatatatgtgagtgacctgcaatttaatataataaaatatgtatttcttgagttgctcttacatgtactatgcaaaagttcatatttacaatgcattatcatggctaaatcataaatatgggaaagtcagttaaataagactttaaaagaagaacccaagtctagtcacctaacacttacgaggcatttctcattgagaaaccggattatcttttatagcctctggagactcagagcctatcccaggttcctacacatccaagaacaaatgtgtcctgagcagatgaatgaaagagtaagtggacccctcaggaaaagagcgtttttaacaccctgaattaacctctcaatattcctctaacaagaaaaagtgttaggacactggggccttaacattagctttcctactcactgagtgatcttgacaagttacctaaacttttatttatgtatttatttttgagacaggatctcactcaggttgtcaacaatcgagggtcataggttcttcacccaggctggagtgcagtggcaggatcatagatcactgcagcctcgacctccctgagctcaggtgatcctcccacatcagccgcccaagtagctgggactacagggacaccccaccatgccgagctaattttcttttttttggagatgggtctttgccatattgcccacactggtctcaaactcctgggcttaagtgatccattcaccttggcctcccaaagtgatgggattataggcatgagctactgtgcctggccatcctaaacatttggacttcagattcgttatttgtgaaatggaaagtgaagtcatcataaaatctctttcaacgtattggaaggaagattaaataaacttataataggtgaacactttttgtaaactctacagtggtgtacaaatgggatgtgttaactttatatactgttgttgtcagtccagtgattcccaaaaggtgaccagggaaccctagctcctcagggataacaagcaaagccagtatccttttcagcctcagaacttaccagagcctttgatgtgctaatgagcactggaacactctgtaaaagaggagcatggtttgtggcatttcccaaatacatttgtccagaatcttctgtcagagaactccttaaaggattcacgttttagtggggcacccactggaaaacactgggctatcatgtggactgggcctacatgggtttatttggtagacatggtgccctgctcacccatcctcttcagcctctctccctcgtcatgcaggcagtgctttcctgaagagtaacaatgaggagatgggagaaagtagattatctgtttcttaactggctctttacctctcaaataaccttcctctttggggcatttttgcacagttctctctagatttaatgcattgagggcaaaataattaacccaagactgattgccatagttattattattgttctcctcctcctcgtcctcctccttttcctcctccttcctctttctcttctcctcctccaacttctccttctactcctgctcctgctccttctccttcttcttcatctctgtctttttcttctcttcttcctcccacttcttttttttaaactcaactatgtgatgatttcttcttttacaacaattttattgtcatagtttggcatagtttacaaattttcaatgaaatataaaccctaaaatttaaaatattgctctaagaatttttaaaaatagagtcatctttaagtgcaaaggggcatattattcaaattcaattttgaagtttatgtttgtacctttcctggggttaggggccattttagaacatggtaatcatggacagtatctgatggtactggtggccatttcaatagctgttagctgcaaattcaacaagtataggatacctgtctccttcttgggactttcatggcataccccttttcccaataatgctgtgtggtaaaaaataatagtaataataatgctgtgaggttcagagagactgaataactctcaaaagtcatgtaaaaaagatatatgacagagttactatttgaacaaaggttttcagactcccaggtattccctgcaaagagaaggtatgaggaacaacccctttgtctctgtgaccccacagaagcctctgggaccccactttctgattcttcctcctattcctttttgtctttgatctgcttctatttctcctctcccttttcctcttgtcttttatctgatccttgccaatcgtgctctccaaaatgaagaacctatgatccctcgattgttgacaacctgagaacatttcttgccctacccaggacagaaggaaatgacataaaaacattttattcattgggtgaaatgggattatttttgagctgctctgttcaacatcagtgaggctgctcaataaagagaagaggaaacctggcataaaagaagaaactgggcttcagctttgcatgcatatacatgtttattgcagcactattcacaatagctgcaaagacatagaataaacccagatgcccatcaatggtggattggataaagaaaatgtggtacaatacaccacggaatactgtgcagccataaaaaaagaaaattatgtcctttgcaccaacatgggtgcagctggaagccattctcctaagtgaattagtgcagaaacagaaaaccaaataccacatgttcttacttataaatgagagctaaacattgggtacccattgatataatgacaggaagagcagacactggggactccaaacatggggagggagggaggagagtaaggactgataaactaccaattgactactatgtttactccttgggtgacgggttcaattgaagccaaaaccttagcatcatatccatataacaaatgtacacatgtacccccagaactaatatttttaaaaaaataagaaacatttcctcccagagacagtgtcctaatgtggttttatcagagtcggttcttcctggtgggagataataaataatggcatcttatccagaagacttcatcaagtacctgaagtttactctgggaacatctgggctgtagcccctccttccaaggagctctgggatcaacttctgatactgagaagcgtgaagttcgaattcaactttagccttgttatgcttgtgtgtgcactttcacacttattgttaagggattcgtgagtggctgaggagaggagacacagaagactccctttctttgtaatgtgcaaaaaaccatagagaatcagtaaatgcagatgaatgggaatataaagcacttactgttcttatggttcaaaggttttagaacaggcacatccacctttactcagccacaaccaagaagactggaattcagaagcacactcgacctctaagcctgcctttctcatcatgctgtctcacacttctccctggataaataaaggcgacctgtgccctagcattgataatgatgctggggacaaagtcaagctccgacagtgttgggacagtctctggagtctgcctgggccctggcgcctgaaatggcctggctggtccttaggccgggccaccttgcctgcctgttttctggtttctttccctcctgggccatctgtttttcacctgcctgatggctgcagtctgctttccatctggtcatcgttccaaaaacatgggaagcagaatatgacaaatggtgataaatggaaagaaaggagtcacagaggtttcagcgttgatcatccacagatttaccagccattataaaatttggctcctgcttattcattttcatctgcatgccaaaagcaatcgattgtagaaaagacccgcattctttgtctattttacttgccaagtcagttggagtccagatggtgacactgacctttgcagagttcctcattcttcccaggaaatgtacattcgaggaaaagtcaagcctcttaccactttagtggtaccattaagagggtggttggggaacctggattattttaaatgcatacacgcacacacaccaagcctggaacatgctgcttgctcttatcatcaagagtgttataattttgggctggctggaaagcaaaagctccaagttagaaagcaatctgttccacccctgccccctcaccctccctgaagccagacggctgtagtgcagctttctcctcttcagacacacaccgggttggagcctgttaaattgcatcggcactgactggacctcacagaggcccatgttctatgcccctccgggaaccctcattggcttttggatactttccttgctactccgagttcgccaaatgctgtgatagacccttgtaaggtcacaagagtgcaacaatgagagaaaaaaaaagctgtgattctaaaactgaaccacactcctacattatcaggatttttccattttccagtgagagtggaatagagaagactttctgccctggagcctggttcctttccatggatcttaacaacagggggaaatagtagaccctgcacctgcaggaggaggagggtctggggaaagacaaagctgggattaacctcatgctactagttataaagaatgatttggaaggatcagtatcacccaaattagctatttgccaaacactgaatatctatcaactgataaccaccctcttattattgaaataattttgttttcataaatccagttctaattcaagaagatgccgtttcatgtgaactccatcagattacagctctccaggcacaaggggtcgctggcttagaatcaaagcacatgtccagatttcctcctcctcacttttcttcttggttgtttatagatgcgaaattctctttccttgcttctccattctgtggctttagggatttagaagaacaagagctaaatccttactttgtgtcagggtccgtaacaaaggcttcacacgtcttaacatgttgagtcctcagagcaaaggcatggagagggatatactattatcatccccattttacatatgaggacatcagggcacagataggttaacttgcccaaggtcacaggctagtatgtgtgggtttgaaccaaggccatggagctccaggatttgtgctcctaaacatgttgctgtggtcccccttagaatgtagagcaagagttctcagctgggggtgattttgcatttggcaggggccctctactttagcactgtctggagacattgttgattgtcacaggtggagaagcactcctggaatctcgtgagtggaggccaggctggagatgctgctaaacatcctctaatgtacagggcagctcccctcagcatagaactctcctccctcaagtatcaataatgctgacattgaaaaaaaccccgatgaaaagaaatcaccggacacatacacagaaatgtacacagatgtataaatagtaaatcaatcaatcaatctatctctgttgatccacctatctagctagctacctatgtcttccttctgctcccagaagacagctaaaaggtttactcttttgaaagggcctttaaagtattcactattttgaaagcttttagtagtaattttcatataagagttatagagtaaagtgatttacaagttattgttccttgaaaatatagtggtgtgtgtgtgtagtagggatggctcccactttagttcctgtggactttccctttggctgtggaaagtccaggtcattccctaagaccttgtacctgtgatttttgtctccacttggcctttgagaaaaaagctgggccaggacaggtcatctggccaaggccaagttctcagtcattttaattctaattacatccagcttacattacacattatgttaatatcacactccatcatgttacagcaatatacattatgtaatatattaatagacattacctattctgttattagcacatgacattaatacaccttatattaacacacattaaatattacatcaatacacattacatgctacattgacagcacattacaaattacattaataacacattgcaaattacactaatgcatactacatatcacagtgatgcacactacctatcacattagtaacaccttccatattacatgattaacacattacatcttatatttatacacattatatattacattcataatgcactcgatattacataacacattacatataatgtaattatatggaatatatgattaacacattacatattgcattaatgcacattacacattatattaatatgtacatcctgatgcctggttgaaggaagctcattctttctggagtccccaactctaatattcctggtcacctccagtcctagttgtcacctgcagctgatctagacaacgctggtttctcaaagagctgacagttcccccaagggcagctccctcccaggcaagcacaggccccttggctgcctgggaagttctccatgttcttcaccctagcttgcttcacggcccacagacatcccctttgtgctgtgcttacccagtggggtcctggtcctttggggtcacccccacagctgctctactacagcctacatggctgaccagggagacaggtgaagcgatgtcagtgcttgacaactcacacggcccagcgagccattcctcaatgctgatcagttcccacaagtaacaggctctggctgagtgaaggagatggtgcaggtgcaggtcaagacagggtcactgcccttctggagcttgggtctagcaggagagcggagtagaggtaagactttaattaaaagacccattgataacttggaattaagggtgatgtgctgttatatctagctgtgaggaaaaagatcatttggtttcagttcttagacctgggtgctgggcttggggaagcttgtccaactcttctttccctccaggtgagttctgtcttgaggcctctctttcatttgttccccctgctctgtggtttctaggtgcattgcccatccttcagagagctctgtgtgaatccataaaaggtgcttaaagcttttcactccatgaagcctcatctgtctcatgaaagcaataaatgtaagtggacatttgggaggaaatgtttgctttgcatgctcataactggatggctcatttggatggagattgccccagacatccatgtaagtcctccatcctagtagacagcaaactactgcagcacgaaccatattacattactaacacactacaaattatactgatacacactacatatcacaataattcacattacatattacattagtaacatcctccatattacatgattaactcattacaccttatatgagctggtttgtgctgctccctatgtaagcaccctctgtaattccatcaggatctcaaaggtctggagctcaggttcagccacagtacctgcaatgcaatgaaattaatggtattatgatagtaatgatatgataatattaatgcaggctgttgtgcagtacacctactaaggttctgggaaatagaatccacaagacatgatatacaccttatccttccttttcctccaaaacactgccacgatctatcaacaccatcatttaacagatgttgaaagaaagactctaaaaaataacttgcccaaggccagtcagtgagttggctgcaaactctctgtctttccccatttcttccttttctctattccacgtagtatttaagtcatcacctcctgttcaccccacagtgctcagctctgccacccctcactcactggagcaccagtgctcaggtcacccactatgcctaccttgcacatcccacctctggctgcacccacaggctcacgctaggcagggaagggcaggtaagggcatcaggcattgtgcccttccatagccaggctcatggagggctttctgagcagagattctaattctgccagctgacctggtagaagcccccaggctgcagccctgttctgcccacttccactcccatgcatagggacatccacaacatccacactccaggtaactgaatccacctccccactgcagcatttcagaagatgctaagtgcaggatgaaccacacacttccttctccaaactgggccacttttgagagtaaaagaggcattattaataactgagacaacaggtggatgctggacatatgtcattcaccctgtttgacaaactcctgtcgcctctcaccagcagaggaggctgtgagaccagaagacttggaaggaagtggcaggcactgattgtttctaagggagctgggttggatcctcgttttgtgtggttgggaggctggcagctggcagtcccctcaagccaagcatgatgtagtgggggtaggttatctttcttctcactgccttagtgtcctcaggattgccttggggccacttttcttgtcatcaggaagtgagcaggaccacagctgatgaccctcagcctgtcattttggtgcaatccagggtttaactggccggggagtaaaggggactgttgcaccattccaggctggctgagccttgtatctcacctccccacatctctgtatccctggggctaaatggggctgtttccatgctccttctagaagcttctccagcaccagccttcccccaaaccagaacaagagcattgatctacacccaagaggagcaggaatcagcagaaacacaatggaacaaactgatatgccatctagtggaaacacagaaagcctcaaatgaaaatctcagccaaaatgaggccactcaaccagtgtccagtgaatcaagtttctgacaaaagtcagctaaatcaaacacctctgtgtttcaccctttttgatggcaacgccttaaatgtgactgctgctcagaaagccaagtaaagaaaatataatggggctgctattggctcattccgaatcaggcattttctctcaggtcagcatttgggatcagaattttgattacataatattgtcgaaggcaacagaaaaggaccattgactcacagggtgttacagctgataaaggacttcagaattaatcaacaaacattgaggcaacattaactaaaggtcaagaactattctaaccaccttataaatatttattcacttaattctcacagcagccctatatataagcactagcattatctccacttgacagataaggaaactgaggcatgaaaaagttaagaaaggtgctcagggacacacagctgataaggcttcgcacccgtttggttaggctcggaagccactgcaccatgcccaaggtcacagagcaaggagtccaagcagtatttcccttactcagagatatgaatagccagaaacacttaggatgtttggttttacaacccacaacctcctcccccaccttcgccaaaagataaactattttctttttttctggaacttacctaacataacataatctacataaatctacaaaataatgttgttcatgagaaaggcatattcgattcaagcttatccaccttaaactgcttctgcataaccaacctagacgtatacagagtcccttctgttagttcctttgatggatttttgctttttttctcctgaaagtaaaaagcaggaacatatactgtgatttattaggttttgcatctgtgacaaggaatgcagtcctagagagggcggtaattagctaatgcttctggaatgctgcttccttcccaccagcccctggaggtcagcaggccaggggcgaaggcagctttgtcctgcccctatgggaggttgtgtttctcgacccagtgtcttgagtttgcttcggggccggcatctatggagagcagggagcatttgcactccttggggaagaggcatgaggaggggcagcggtgtcctaagctcctagtgactcagtctattcttgacctgccatcacagggatgagtttggcctgaatgaaagtcacacaccctgagcaggctctgaggtttggtttagtccacagtttttcaacctcaggactattgacgttttgtcgtggggctactggatgcactgtgaaatgttaacagcatccctgaccctccaccactagatgccagtaatggctgtaaccgtaataggttcgctgcctgatgggcagccagcaagtcagtacaccgagacagccagttgcagcagagaaagagggttcattgcagagccgctgaataagacgggaggaaacctcaaatttgtctccccgaggagttttagggttagggtttttaagggttttagagttgaccaaagtgtggagatcagtggttgatcgaagagtgcagggtgaaggcattggacaagaagatgaagacgctgtattctcatactgattcagttcctctgtgaggtgagggtcttctaactggttggtgtgagctgttccactggaattcaggatctgaaaagcatcttaagcaattttttttttttttttttgagacagagtctcactctgtcatccaggctagagtgcagtggtgcgatctcggctccctgcaagttccacctcccgggttgacgccattctcctgcttcagcctcccgagtagctgggactacaggcgcccaccaccacgcccagctaattttttgtatttttactagagacggggtttcactgtgttagccaggatggtctcgatctcctgacttcatgatcagcccgcctcggcctcccaaagtgctgggattacaggcgtgagccactgcgcctggccacatcttaagcaatttttaagcaaaagccttgtgattctaacctcagagatgctatctataagaacaacagggatacagatggtcagtgtctaggcctacctgactttctgttacaaggaagtgggccgaagtgcagcctgattaatgcttaattataactatatttctgtacagaattcttgttaagaattattgggtccaggattgacctaattttcccaaattatttaagattaattataacatggcctctcagattggttcaagggtagagtgagggggaccatgccatttgggaagagccattcagacatgtctaataagtaagcattgcttttctctaccttactcaatattctttacagatttcagaaacagcctaaaacaacattccacacattgaatgcatatactagttcacagtgaggccctagagtactggaagcaaagctgggaaaaattaaaattctaaatcttctacacagtaaatgcaaacatgaactggacattcctcatttcttccatatttccttttctaccatctttagcctattctcagcctcagatggactgacgcattaaagctccagagtgtgggtaatttatggaacttgaaaaatgcatgtctgggagccatggagagagggggaaagggcagtcccaatcagaccctcagtctcctctttgtctttcatgtactctctaatgtctactccattgagtgtactcttggtacccaactcctttaatgggagaagctttcagctgttgctcagggtattgctgctcatatgcactaaagccattgagcacactattcaggggaccctcaccagccctcttggatatttgcactattggtggtcctgaggtgacctcaaggatgagtcataggagttagtcaatctttcaaagggagtgtctgttccctctgctgggagatcgtgtgttatttgatgcaaattttcaatacaaacccactttaaatacagaagacatcccagatggaaaggaaaaaccttttcagacagctattcttcaatttggtttctggaggcataattttcttcgatggtaggcagaattctaagatgacttgtgccttgaataatcccttcctcttgagtaggggcaagagctgtggatatgatgggatctcactttgtgttataatgtatggcaaaagggacttctgcagatgcaattaaggtctcttaacagatgagttaaggtaaagggagactgccccggttgggccttatctaatcaggtgaattcttatggtcttaaagtctgagacagaagtcagagagaggcatgttcctgctggcctggaagaagaaagcagccacagtagctagaaccaaagagtggtctgagagctgaaagcagcctcagcccaggagccagcaagaaaatggggacctcagtgctacaatcagaaggaactgaattctgccagcaaccagagagctggaagagggccctaagcctcagatgaccttccagccctggctcaataacttatgttgttttaagtcactaggtctatacgtaatttgttatctggcaatagaaaatcaatgcaccttcattttattttgttgctaaattggatattcactgtattttcttatttgctttgttcttgatgctctggcatctagggccttgttgacaggaggaaaccacccttcccaaggctttactatcccaaagattgtaaaggacttgccctggagcatgcttttcatatgaaaactaaccaatccagaggccttactttgaaccaccttctctctctggctcttacactccaggaggtaatgttcctctgctctgatcatctcaggaccaggtaccagacagctagagacagcccctataccctggagcctatcaaaattacttaatctagcagatcatacacctacctagtctgtttaccctgcctcacctgttccttcccatgaaaaccacaataaagatgtctgcctctgctttccccatttccccactctgcttccttataaactttggtccttccatttgtagcccctcctcttgggaactgtgaataacaaactatcttgtcagtaacagtcatcgtctgatttgttggcctcaccatactggaataataataaaacctatttaaaacaaactgttaggatcgttttgcttatacatttcttctctatgtgttctactcagatcctcccaaacttcagaagtgtcaaaaaatactaaatgcagattattaaatcttgaccttaattaggttccattgtgaattttttaaataaaaagattgttttagtattaaaaaaattcttcacaagggataacaagcacatcttggcttttgtcccttcttacagatttttagcataagctgaaagaaaaataaaactatgggaaagattttgccagacaaaacagaacaataggcagagttccatgtaaaatgcctgattggtgcaggcagccagtatcctctaatggaaaaattcacaaatgtaacaaaaataaatggtgcatcatacattatgtttgtcaatacttttgtgatgatttatgctagaatggcaagccagagattgcctaattttatgtcctatgctttaagaccagcctcccatactttcctgaacgtctgaagagcttacaaaagggcttttgctttgttttactcaaagaaaagtgaactccttctcttactaatgatttgagcattttcctctcaggaaacaaataatatttaagcaagtgatttagcatgacactattttttgcttctaatgtaaaaggcctattacttacaaagaaaaactagatatttataaataaattattttgttaataatgtgctgttcctttacacatcttattatcttgtattaatagctctagccatactgacatttttagttttatctatacatgatattttctctaagaggcagattttagaggccagtcaagcatttggatataattttgtgcaaggattttttttaatttacaaataatggtatcacatacctgagcatctgcaaataaattggtaactgctatagttacaaataaacacacactcatgtatgcacacacaaccatgatcataaacatatccctgtgcctctcccttttctatgcacacctcatacatatagggggtatgtatgtgtatacctgtgtgtgtgtgcgtgcatgtttttaatactaaaacaatctttttatttaaaaaatttgcaatggaacctaattaaggccaagatttaataatctgcatttagtattttttgacacttctgaagtttgggaggatctgagtagaacacatagagaagaaatgtataagcaaaatgaccctaacagtttgttttaaataggttttattatgtttgtgtgtgatactcttatcaactaattgggcagtagattttgtattatggcaaacatatcactttagaatttgacatgcctgtgactgacacccacactacagcatacttacttcatcattgtaactttggatattttaacatatttggatgttcatttatttttacaacaggaagaataattcctatctcaccaagttactaagacggttaaatatggctccacctgcctgaaatcctttttctcctgaccatccacactgatgtcttcttgtcctttgaatgtcgctcactgttgtagaaagggtaaccctgactaattagctaacatagccatctaatgactgttatatctcttgattcatagcacttgtttatgtctgctttgatcatattcatttcattaaatatatatcttactccctctgtaagagaacaaatgctgtgagaacaggaccttgtttgacatgttcattattctagcatccagtgcctgaaaacatgcctgacacatagtagtcacttgatcaatatttgtatgaaggaaagaaggaaggaagaaaggaataaaaggaagaagaggggtttggtgggagggagaaagggagagaaggacaaaggagtgtgaaaaagagggatgaagggaggcaggaagaagtttaaatgtccaacacaatgactaacacattacataggcactcaatatacttcaattttctattttgtaatctgtgaattttggtaagtttcttaaactctttaggcctcgcttatcttatctgtaataatggtacatgcagtaccatccattaggattgttataaggaataaatggaaaacaaagaaataaatgcagagtatattgcactgtgcagaactatatactcattaaatattacatattaatatttttgttacttcccccaaatgatatcatcggacacaaacttctgagttcaattagaatttataacttacggatatgaatttgttcaaatagtgttatatttccttttataaaaataaccatttgagatatatgaaacttgaactcttggcctcaagtggttctcctgcctcagcctcccaaaatgctgaaattacaggcatgagccactatgcctggccatttgtgatgtaattaataagcaatcaaggaaatacttaactgtacttataattattaagttaatgtgaccaaagttaaactttaatacaaggaatgtgtgagcccttaactaaaaattataatccctctgcttgtttgatggctgaatcaaataaaccataagaaaaccactagaaaattatacttgttttcaatacatccttatacttctgaatagataaagaagccaccttaagtttttattaagaacagtttttctaaccgcaaacaagaataaaacaataaggtaaaatgccaccagaaaatgaaaacgtgagtaatgactttcttttcattgcctgatgggtatagagggttattttttcccgtacagcatagtttaattttttttcatttcttataatgaaattactgaggtactttaatgaagatttcctgcaaaatagattaaaacttacaaagtgatacaagatttgtgctttcagccagaaattgtcttttaattggccagtacaaagacaagagaagctaagggaaatggaataccatttgtgtcatttccatcacaccatttcttattctcagcacttactgagtgtgtaactgctgagagatttgccaggtgttcactcacagattgatagctccatgtataattccaaatgatagagatggagtgttgtgtcctctgatagcagaagcagcagccactgccttccccacaaacctgtcacaaagaaatcagtggggattggattttgccctgacctggataaaaggacacttcatcacagcaacagcctgctgggagaggagggaatagaccctgctcttgctgctgcagatgcctgcaaaggatctttacttggaggggtcttggagctcctttctccgcagctacaccaagtggccaggtatatgtgcacatatacagtagccacctgctttcactgttgcatgttacgcaatgaatctcaccatgggagtgaagatgcttctggttcttcaaagtgagacaggaagaggaagaagaagaagaggaggaagaggaggaagaagaggaagaagaaggaggaggaggagggaagagaagaagaaggaggacgaggaggaggaggaggcggtggcagtggcggtggaggaggaggagggggaggaggagggggaggagggggaggaggagggggtggaggaggaagaagaaggaagaagaggaaggaagaagaagaaagaagaagaaagaagaaggaagaagaagaagaaagaagaaggaagaagaagaaagaagaagaagaacactgtttggtgggagctatattccaggctccatagctggttactccaagtgaagaaaatgcggcttcaagaggttgtgaggcttacgtggcaggatgagggaagtgagggtatgggcatttatgtgatgtagcagcagcagcttgtcccagtgggaaaacctcaccctgagaggtcatgggaaatcccgagaaccacatagcacttcccatcctccatctttcctttcagtacagttccccacaatctctactaccacccccaccctctgcaccaggctcttatctacgttttttggaaagaagaccatcagttcaacaaatgagcataaaacaagactctcacagctggagcctctcccacagtttgcgctttctcctgagagactctttgatctctcctgccattgtcttggggccatcccagtggttcttcagacatgcctgaatatgtctacattccaccagcaaatgcccagactgagggtcacacacctacccacacagacacaaaaataatctcactcatcaacagtggtgcactaagtctaaggttacaaggaacagtgacacacaggaagtgtgctgtcagataagagagttatacacttcaagggacaaccaaagtggactctgatgaggacctgcatggaagggtcctggtgtctgtgcgtgaacactggagggacacttaggtctgtgaggcctcaggaaaggcttctgaaagcaagaggccctgaactgaaacagctaggtgtctaagtgttctgtggctgaaggcaagaagcaaggacaatctaggtacagggaagctgacaagggaaggctcagaggcagaaaatacttgggtgaatccagagcccccatctcgcttaatatgagaaaaacctagaatcccatgcagggagtggcaagaaaccaagctgcagtatcagcagagactgagtcataaagggcactgagggacatagcaggaagctcagattttgaactgacagaaaaaaagagtccctgatagactcaagtttctctctcagattgatagcttcatttataaacccaatgatagaaatggagtattgtctttgaataataggagctatcacgattatactgtagagcttttggaaggctaccctggaggcagtgtaacagaaggtcagaaattaagagggtcacctgatgaggctactgcaatagtccaaggggatgatggtttgggcctggactaaactatggcaagtagggatggggagtagataccaagaggagagtagcaggtagcagggccagatgacggcctaaatcgaggggtacaagagagcttgcacgaaataaacaatcagccctggcaggactgactgggactgcccttgcaggacgaagagaggaagggttaaaactacatgtcttgaggctatttgccaatgtccttaggaagcagggagtatggctaatggagcttttagtcctaattagccaaaactgggatcctgccaattttagaggctttcaaggggcatgcttcaaggaagagtccccctgagcttaagtaatgagtgatggcctgccatccagcccaggggcaatgtctctaaccctgggtcatgccagaattatactcccttgactaaacacatcagtttatccaggacccaacatatttcattttatttaatattcccccaaaccccaagtagatgtacttactactcatttcacagataaggaaacaagcttcaggagaagcaaggccatttttcacatagttggtaagcattcaaaacagtattcgaatgctggcctgtctgattcctgggttttattctatccactatgtacaatatcagaggggtccatgtgtttctcttctggacagagaaaagagtgaggagacctcaacagtggacactagcctccacaattcagaatgaagtaacctgggacttgcagaagagggaatccacattgtttcagttaggtagcatttggtgacagtgataacaatgataatgaaaacagcagcaactaatatttactgagtgcttcatatgcactagacattgctctaactcatgtaatccacccaaaaacctacagaaataggtattgtcatgatgtccagattgttgagtgaaataattttacagatgaggaaatgggcccaggagaattaaataactcttccaattgacaaggtagaggtggaaacagcatggaaattcaggcatccagcttcagagctcactctcctaaccactatattatgttctctatggtcaggttgaacacagtagtttgcctcatgttcctttatggtttgtgaatgcggctgaaaagtcccacaatcactaaaagacaaaacacagtcaagctttttattcttccttcaaaaaaaaaaagttgatgggaaagggtgatagtacacacatagggtccggcaataaatcattttttccctcccgtttcacagtgaagggcataggaatgaaatgagcttttagaattcctgagaatcataggcactccaccctaaccacagatgctggaagctgcattatgatatgtattacattcaaatgtgggaacccagggctaattttaagcaacagttcaagctggatgtaattaaaacctgcagcattctacttctggaaatgactaagaagcttgtatcgtactaatcctctcacaggtgacaattgtaaactatagccaagtttaaaacattatttgaaggcactgaagaaggaagaaatgcaggctgaatgtggaatagagtcagccttcaacaaagaaaactgcactgtatgtaaatggattttgcagggtgtttcacctgagaacacagccctgtctgcacaagatgaagtggctgagctcctgcagaaatatgcagtcttccttgtttgagaagtcagagtatggagttcataactggaaaaacttctggggtgtgaggtgggtaggaatgccaaaaaggaggatgtcaaggaggggggatcccccaaatctgtgtgcagactttgccccagttcctggctgactacacacgcataaactgcgcatgcatgtggaaaatgtcaagggtcctagaaggaggcagcagatggaggacagagggaattgagaggagatatcaactgcagtcccccacagacaggcagccaacttcaccaccctctaaggcagaactcaacactctgaccaagtctctaaaacaaaacatttacaaagcccatagtaaaataaaatattggtagacatgtgaagaaatagaaaaatgggactcaaaaaaagaaaagcagtcattagcaaccacttctaaagagaccaaaagtttggagttatgagagaaggagtgcacagcacctatgaagagtatatgcaaagatataaaggaacacggggtcatggtgagggtcaactgggaatcctggcaggagaaaataaatatatatacataaagaaataattatagaactaaaaatcaaaatgtctgagatgaaaaattcaattattttccttaagagcagattggagaaagcagaataatagacagagacaaatagaaagcaagtaagaacttgatagacatgaacctaatgatataattcattacataaatgtagatggagtaaacatttaaactaaaaggtataaatgatcagactgtacaaaaatataagactaaactatatgctgtttttcttagtgatggttctctagaaaaacagagccaataggatgtgtgggtgtggatgttgaggagagagagagagagagagagaaaaagagagagagaaaaaaaagagagagagagagacttatttaaagaaattggctcatgttaccttggaacctggcaagtctaaaatccgcatagtaggccagcaggctggagacccaggaagaattaatgttgcagctctggttcaaaagcagatggcaggtagaattccttcttccttgggtggggaacttccatctttttctcttaaggccttcaactgataagaggatgcccacccacattatagaagataaactgctttacttaacgtcccctgatttcaatgttaatctcacccaaaaactgtcttcacagcaacatccagtctagtgtttgaccaaatatctgggtgccatgaccttgcaaagtttatgttaaagcataaaattacagaacctttttatccccttatagtcttggctcatctttatgtttttgaatctcataactgcttctgtttgatcacagcttgattcactgatcttattgcatggaggcattgccttcttttattctattgagaatggaaaattgtttccaaaataatttatttctggcttttctataaatcattttgaaaagtctctgtgcttctctgagtcttcagggatactgattctttcaactttttgaatcttttgttcaaatcaggactgtattgatctttttcttttagattcattcttcacaaaagaaacatttatctagacttgacaaaagcctagagaaaaatgtgttaattgccctttcatagttgattagattactggttatattggtcaaggctcatagtggaagaaagtagaatgcactctatttgatctgaaaagaaagtgatgtatcagatggaatgatgaaccttacagaatctcagtgaggcccagggcataaggtttaattatcacataatcaaaaatacagcaatcaaaggaaatgcccaaccacctatggaactgtttctgttgctgctgcctactgctcagtacctaagtttctaggaatcagacttcagaaactgccagacctgcaacgggagaatgaacgtttctgtcacgaaccatggccactggctcccattgttcacaccctcctggtctcatgtggacatctgcttggcagaatctaagccacatgcaaaatcttctctgctaagtacggtttttagtctcctggcatctgttatactagaaggttcagtagaaggaagtgggaatggcagcggagtgagccagtgaaaaatctgctgcactaaacaatctcagtgctggatggaatacccacatctcaaatccaaggtctagaagacctttatccatggtggcttcactgtaaatgagtggacctctcatcatgtcactgattttctgggactctatactaaagaaagattttttaaaaattgcaattccttcttatatcaactccagggctcctccttcctgcatcttcctccacaaagctttattttcttaaatgaaatgtgtcaccagcaattctctccccaaaccttccacaccacaactcaccatactcactagatttttgagaatcttagtcttgagtgaaaatacaagtgtgtggggaaaaaaaggagaagtagattctgaccaccaacacagtagaagacgagccacatggtttccaggctggcacagatcctgggtacatgagctgggaacagacttgatgcagggataattttgggtaaattaattgacctgtttaaggatatttggaataagttacctataagcagaattctagaggtaatgtcctatgattttataaaatctggaagtcactcatttacatattggaaattctttttcttgacaaaaatgattcatgacttcaacaaatggtgctagaacaactggatgtctatgttcaaaagaatggtggagtaccccttcttcactccacacatcaaaaccatctcattgttcaattcccacctatgagtgagaacatgcagtgtttggttttttgtccttgtgatagtttgctgagaatgatggtttccagcttcatccatgtccctacaaaggacatgaactcatcattttttatggctgcatagtattccgtggtgtatatgtgccacattttcttaatccagtctacacctgggactgttgtggggtggggggaggggggagggatagcattaggagatatacctaatgctaaatgatgagttaatgggtgcagcacaccaacatggcacatgtatacatatgtaataaacctgcacgttgtgcacatgtaccctaaaacttaaagtataataataaaaaaatctctgaaaatatacccaagacctagatgtaaaaattaaaactataaaacttttagaagaaaacataagagtaaatatttgtgattttgagttaggcaatagctttttaagatacaacaccaaaaacacaagggaaaaacaaaacaaaacaaaacaaaacaaaatccgtgaattgaacttcaccaaaactaaatgggacaacatatttaaaaatcacatatctgataagggacttgtatccagaatgtataaatgataccacttgcaactcagcaataaaaagacaacccaattaaaagcagacaaataatttgaacagacattactacaaaaaagaaatactaatgatcaataagcacatgaaagatgttcaacatcattagtctttcaggaaatggaaaccacaagacatcactttacacccactagaatagctcaaaaagaaaaggcagacaataataaatgttgtcaaggatatggtgaaattggaactctcattcattgctaatgggagtaaaagagtgcagtcaatttggaaaacagtttgggagttcttccaaaagttaaacatagagttaccatataattcagcaattctcctccaagaatactaaaaacatgtgtccacacaaaaattcacacattaatgttcatagtagcattattcataatagcaaataagtggaaacagcccaaatatccatcaactgataaatggataaataaaatgtggtatatttattaactgaaatattatttagcaataaaaagaaatgaagtactgattcatgttgagcatcagtgaatcttgaaaacatgatgctaagtgaaaagagccagtcacaaaagaccacatatcacatgattcaatttatattaagtgtccaaaataggtaaatctatagagatagaaatcagatttatgcttgacaagggattgtggaggagggggcaatgggaagtggctaccaataggtgtggtgtttctttttggggtaatgaaaatgttataaaattagataatgttggtaattgtacaactttgtgaatatactcaaaatcactgactcatacactttaaaaaggtgaatttcatggtgtgttagttatatctcaaaaaggctattagagatttactggaatttcacaaaaataattgcttatttaatgcaagtttattcatgatattcacattatttgaagtatgaaagttcattgtttgaattaattaaaaattaaaacaacatatcaaaatgtgtgggatacagatttaaagaatctaaattttcattttaagatatagaaaatacaagcaaaagaaaattaaacccccaatagaaagaagacacaataaacataaaagtaaaaataaatgaaataaaaactaaaatataatgataatgatgatgataataataataatggtaataatagtaacatgaatgaatcctgcagctgtttttttttaaatgaataaaattgataaaactctcactagacttatgcagaaaaaaagaaagaagacacaaattaccacattaggagtaaaagaggagcatcactacagatcctatagactttaaaaggatcataggaaatattatgagctgctttattccaataacttcaacaacctaaatgaaatggataaatcctctgtcataatgttaccttgcttgtattggaatgtgtttattctcaggagacccatgcagaaatattagataaagtgcaactcactttcaaatggctcagcaaaatgtcaacagttgttgaaactaagtagtgaatataaaaatgtttattatgttattcttttattttaccttttctgtatttttgaaaatttttgtaatgcaaaattgggagaaataaatcaggtatgaatgcatgttagtagagaggctttcactccgggttagtcatttcaagtagggctgattatggaaaggacaatgtcatgaccttttcacccaaaaagcagtgttgtaaccttccttttgtgtctggatgaagcttcttggtgacactggtaggctatggaaactcccacagaacaagcacagaaaaactcacacagacatgaaaccttggcctaaggggacacttattggacactaattacccttaagagctctgttaacccaaacttcccataaaccaagcttggtatgaaataagaaaatgcataaggaagcaaaatgctgacatgaccaaatttatcagtcctgaaagtcctttcttcagaagtgatgttgcaattgtacaataataaacaatagaaggttgacaatctcatgtttgcaggcagagaacagcttccctacatttctaagaagctgtatatttggaaatggattaaattgaaggtagggataattggcattctaaagccaagtaggatgaaacaagcagaattttccatattttaatatgtctctttttaattagagtatctataaaggaaacaaattattgtatagttaccgattctttttaatgaacaaggaaaaatggtctaataatatgagcttccttttggacttgggtcctggctgatgttgggtatccaaggaccctcgctgtctttttttccatgttggacgggtaatgtgcccacattgtaacaaggtttgaggaaggcacatctcacacatgcacatgtgaacacccaagcatcacgcttatgaactacaaaaggatctaccctctccatcttaagtagagacttgagagggagtgataggcaggaagagcatcaaaacttcttcacaggacataattgaatgacttgttacttattttcttatggttcatttattcaacaaatgaaacatctcaattgttcattgctattatagatagacactaggtatactggtaaaaaaaaaaagactaaaaaatgttgtttttatttaacttgcatgatggctgatatagtaaagtcaaaattatttaaataaagaaaaggggtaatgaagactttggatgtagaaatctaggttctcatccaagctttgctgctagcttgctgagggaaccctgagtaatgagtccttaaactccctctaggcctggaggttcatccatcaagtgaggggccttaaccatgtttccaacaacagcctttccggccccatcttcctatgaaggagaaacctcagtatggcctcgtggggaacatcgtggactttggactaaagcacttttggtttgttcaattatttcatctctgatcttcatcatcttatttaactactctgagcctcaatttccttgctgcaaaatgaggtgatgtttgcttaaatgagcaagcaaagcaatcaccacagctcctggcatgccatagcacatggcttttgctcccttggggtgcttacatatgaagaaaggttttgcaatctaaagacagtaatcattttggtagtgagccagctaattgaggaggcaatttctcctccatcagactatcagctgatgtgcaacctaaaaagcatttgttgaataatgtaaaaggagtttttaccagctccttcaattttgaccatctttggactggaagatttcattcaattcaaaaaattcccaatgacatatacattgtgaacactaagattatattctttctggaagctgtgtccattccaacaagtcaggaccatttttacccaacctgtcctaggcagcaagactcctcaagagatacatgcagaggcagagttttctaagctgggctgccacatggtcaccctggggagaaaatggcagaagacagctttcttgggcccacctatcagaaggaagctcctgtggcaacagtgatctcatctcttaggggcccatggtagaaatattgaaagcaaaagctataggaatggtccaatataacaatcacagtttccttcaattttcagaaaattataaatgattaagaatacaaaatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaagtttccttctagggtttttatggttttaggtctaacatttaagtctttaatccatcttgaattgatttttgtataagttgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccatagcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaattaaaaaaaaagaatacaaaatggattcaaaacttacagataacttgtaaaaatcaattttaaaagataacctaattttaaaatgttcagaagtcttgatcttgatcaggcatattacaatatagcatgggccactgatcaagtctccagcagccaaatccaccccctgccccagcctgtttcttataaataaatttcggtggaacacagcctagcctattcattcacacattgtccatggctgcttttgctcagcaacagcaaaactgaatagttaggacagaggccatatggcccgcaaagccaaagatatttactatcaggccccttagaaaatgatttgcttgtccctgaaatagaagctatccaagtgactgataggcatatgaaaaaacactccagcattaattgccaacagaaaaatgcaaattaaacccacagtaagataccattatccactcattagaatggcaaaaattaaaaacactgacaacatcaagtgttggcaatggtggagaacagtgggagctctcatacactgatggttgaagtggaaattggttcaattttggaaaacagtttggcagtatctactacagctaaacatttatgtctccatggctcagcaattcctggtcatattctcaagagatatgaggactgtggccaccaagagacatgtatgagaaaggtcctagcacctttatttataatagccccgaacataaaacaataaatgtctgtcaacagtatgatgaactaaataaattgtggtgtatgcgcacaatggaatagtatatggcaatgaaaaaatataagctgttgccccatgcaaggatgtttcacagacataatgttaatcagaagaaagcagatctcaaggagtccatgttgtatgattccatctatttgaagctcagtaacacatggtactagaagtcagaatagcaattacctctaggactggggattcatattgaaagagaatgaaggttgggaagcctgttggggcctgggaatgtcttagatgttgttctggcaggtggttgcaagcctgtagacatatgtaagaggttattggatggtacactgaagattgcagcacctaaccgtagaaggtacagtgttacatctcaatatagaagagaaaatattaaagaaaaaaagaccgtgggtccttttggacttgaaccttatgccacagtggtactacagagtcatgtcttaactggaactcaaattgtaatacctttaaagctttgtgttgaaaagaatgaacatttcagaatgtaattctgcatttgtgatgaagtcctcctcaataactgattcaaagctgaggagactgcagtttcccctaatgccctggccctgtctctgatgggtacatgtttgttgagacatctaccaaggggatcaatgccccaggctgatgtcactccctgtgcttgactcctgtgtctgggtggcaatcgagagccttcctgctcccccagcgagggacggacaggaggaagcaccctccaaaggctggcctgtgtcacagattgtccaggaggtgggcaacataagggatgaggtcatctcttggtgagcccatgcctggccttacagagcagtgacagatcacctgtcacccccgcaacaggcaagtggccccatgtccatgagccacagggtgccagggatgtgggattgtagctcccctgtgggtcccctcaatgaagggaattattcctccaaggagatttgggtcctctgctgctctcagacagtcagttgctttctgactcgtccacacaatggatactgcgtccaattgtatcacaccatcgtggacggctggagtcacatctaaaatgtccttgtacctccagcctccatcactgcacacctgtaactctgctcaccctaagtgcttaatgaacatggtggatgggctggtatacaaatgccttttgggggtggtttgacttacagccatctctgctctcactacagaaagaggagaggagcctcacagaggtaatgtcagtggaagaacctccaaccctcctttgaacacattcctaacaaagaaacctgcatgctttccccaccttttctcctacctgtcttgtgtcagagcagtgcctccctgctgctgatttagaaccaaccaacagctggacctgtttatatctagcaccttgcagtgttctacctagattccaaaaatgaactcaacaatgattcagtgtcattgatcaggttcataatgcttggatttgttcatacaagggctttccctagaaggttacttataaaatgaatatctaataggaggggtttaattattttgtgttgtttttcttactagccatatctccttaaaagtatagagagttgaaattagacatcatttttctttttatcaggctaactgaagtccaactttgaagttttgcaatgcttgtattttaaagtgtattggcatggccctgttagtttcctgtggctagtttactaaggagctaataaagaaacatagagattatgcttccataattataacttaatatggattttaataaaaatggattcctttatcattctctgaattttattttgtgcatttaaaatattatactgaggagtcgtatcagtttgcttgggctgctgtaacaaataccacagatggggtggcataaccaacagaaatttattttctcacagtggagactagaagtctgagataaaggtattggcagggttggtttctcctgaggcctctctccttggcttgtgagtgactgtctttttgatatgttctcacatggtcatccctctgtgtgtgtctgtgtcctaatctactcttcctataaggacagcggtcatattggattagggcctacccatatgaactcaatttaccttaatttcttctttcaaggctttgtctgcaaacatagtcacattctaaggtactggggcttaggacgtaaccccttttctttcttttttaaaattatttttatttttatttatttatttatttatttagagatggagtcccactatgtcacctaggctggagggcagtggtgcagtctctgctcactgcaacctccgcctccaaggttcaagtgattctccagcctcagcctcctgagtagatgggactacaggtatgcaccactgcatccggctaatttttttattttgaggggggggtatttttagtagagacagggtttcaccatgttggccaggctggtctcaaactcctgacctcaggagatccgtccgcctcagcctcccaaagtgctaggattacaggcgtgagccaccacgcgcagcctttttttttttttttttaactttcattttaggttcaggggtacatgtgcagatatgttatataggtaaactgtgtgtcacaggggtttggtgtacacataatgttgtcacctgggtaataagcatagtacccaataggttatctttcctgatcctcttcctcctcccaccctccacccacaagtcagccccagtgtgtgttgctcctctcctagtatccatgtgttctccttgtttagttcccccttataagtaagactaggcagcatttggttttctatttctgcattagttcacttagaattatggcctctagctccatccatgttgctgcaaaggacatgatctccttcttagttatggctgtgtagtattccatggtgtatatgtaccacattttctgtatccagtctatcactgatgtgcatttaagttgattccatgtctctgctcttgtgaatagtgctgcaatgaacatacacatgcatgtgtctttatggtagagtaatttacattcctttaggcatatacccagcaatgagattgctgggtcgaatggtaattctgttttaagttctttcaggaatcgctacactgctttccacagtggctgaactaatttacactcccaccagcagtgtataagtggttccttttttttttttttttttgcaacctcgccagaatctgttattttttgacattttaataatagccattctgactggtgtgagatggcatctaattttgatttgcattctctaatgattagtgatattgaactttttgtcatatgcttgttggccacatatgtgtcttcttttgaaaaatatctgttcatgtcctttgcccactttttaatgtggttttttttttcttgtaaatttgtttaagtttcttatagcttctggatgttagacttttgttggatgtgtgtccctgcccaaatttcatattgaaatctaatccccagtgttggaggtgggacctggtgggaggtaatcagatcatcagaatgaatttctcatgaatggtttagtatcatcttgttggtactgttctcacaatagtgagtgagttctcatgagatctggtcatttaaaagtgtatggcacctcccactcatgctcctgcttttgccatatgatatgcctactcacccttcagcttccaccataattgtaagtttcctgaggactatccaaaagccaagcagatgtcagcttcatgcttcctggacagcctgcataaacatgagctaattaaacctcttttctctgtaaattatcaagtctcaggtatttctttatagcaatgtgagaacagactaatacagatgcatagtttgcaaatattttctcccattctatgggtcatcttttttactctgttgatagtttattttgctaagaagctctagtttaattagaatccatttatcaatttttgtttttgatgttaccgcttttgggtttttttgttgaaatatttgcctggtcctatgtctagaatggtatttcttaggttatgttccagagtttttaatagttctaggttttacatttaagtatttaatctatcttgagttaatttttgtatatggtataaagaaggggtccaggttcaatcttctgcatatggctagccagttattccagcaccatttattcatggggaattttttccccattgtttgttcttggcaaatttgtcaaagatcagatggtatgtggctttatttctgggctctcttttgtgttccattggtcgatgtgtctgtttttgtaccactaccatgctgttttggttactatagcccagtagtatagtttgaagttgggtaatgagatatctccagctttattctttttgctcagtgttgccttggctatttgggctctttttttggttttgtataaattttaaaacagtttttttctaattctgtgaagaatgtcatttgtagtttgataggaatagccttgaatctgtaaattgctttgggcagtatggccattttaatgatattgagtcttcctatccatgagcatggaatgtttttccatttgtttgtgttatctttgattttttgagcagtgttttgtaattctcatagagatccttcacctccctagttagctgtattcctagatattttattctttttgtggcaattatgaaagggattgcattcctggtttggctttcagcttggattcagccccttttctacatgaatattggaggggacacaattaagctcttcatagtctttcgctttgtcccttctttgctgtgttgggatgtaacccagcaaagagtcaacaggggaaggccaccttccatctgtgtcctgtctttcatgcgtaggctcctctctgtgctctcccctccctcccaggtcacatgtaccctgacaaaagccttcccatagccttagtcatcctatgtttgatgggtacccataggagaatggtaggcggcaagaccctgaagccctgatttgggaaatgacctgcagtcttcagtgcagcacagttttaggagtgggcaccagctgtcagtgcacattccttctgttccctgagcagttccttacctctgtctttggtgtgaggcttcagactctgttggataagcagatgcccattaggggcagtgctttgaatagttcatttcaggatgttcaaattgtcagggacattttattacacacacacacaaacaactgtaagaggtggtatttttaagcacttcttaaatgccagacaccattctctaattttacatgttttactcagttaatcttcacaacactatgaggtacacaaatgaatgtgaatgaatgcaatgaaacacgcactttcagtcaaataaacccgagtgctggccattctccagattcattctttgcctgctctatgcccaggagactgactctggcctgcactgcccaggcccccttgcaggagactgcccatacaacagcagccaatgggaggacgagagcagaaagtagaggcagtttccccttttcccgtgacagagcctcactgggcccagacaatagcacttcctctctccttccttgaaacctgggggtgggaacaacttccccctattgctgtcatctgggagcctccccttcccttgtctgggcccttatccctgcccacagctcaggaaacttctgtcatcaaaggctcttcctctgcacaatttgggatgaactgtttcttagtgtattcttatcccatacattgagcaactctccttttatgtgtatataatttaggaaacttttgtgtaagtacaaaatgtgtgtgtacatatttttcttttctcccttttatttatttaaacaatgttaaaacaatctgtccctcttaattttacattttcctcaggtgctgaaataacaactaaaagttgcttgtatctgcattgtggtttctgtgtgtttgccatcaggggaaaacttctttgaataaaatttacataaatttaaacaacaaacactatcttaaacatcataacaaaggttttattttttttaatttttaatttaaattgaatttaattatttatataatttataaattttatatatatttattaatatatttatatatttttatttccataggttatttccataggtttttttttatttccatagattattgggcaacagatggtatttggttacatgagtaagttctttagtggtaatttgtgagattttggtgcgcccatcgcccgagcacccaatttgtggtcttttatccctcaccccttcccaccctttccccccaattccccaaagtccattgtgtcattcttacgccttcacatcctcacaacttagctcccacttatgagtgaaacatacgatgtttggttttccattcctgagctccttcacttagaataatagtctccaatctcatccaggtcattgtgaataccattaattattatacacaaacacacacacacatatacatatatcacagtttctttattcacccattgatttatgagcatttgggttggggttccacatttttgcaattgcgaattgtgctgctatacacatgcatgtgcaagtatctttttcatataataacttattttcctgcgggtagatacccagtgtgggattgctggatcgaatgatagttctactcttagttctttaagaaatctccacactgttttctatagtagttgtactagtttacattcccaccagcaatgtagaagtgttccctgttcaccacatccatgccaacatctattattttttgatattttgattatggtcattcttgcaggagtaaggtggtataacattgtggttttgatttgcattgccctgaccattagtaatgttgagaatttttccatatgtttgttggccatttgtacatcttcttttgagaattgtctattcatgtccttagcccactttttgatgagattgtgtttttttcttgataatttgtttgagttcatggtacattttagatattagtcctttgtcatatgtatagattatgaagatttttctcccactctgtgggttgtctgtttactctactgtctgttccttttgtgtacaaaagctctttagtttaattaagtcccagctgtttatctttgtttttattgcatttgcttttgggttctcgatcatgaaatccttgcctaagccaatgtctagatggggttttccaataccatcttccagaatttttatagtttcaggtcttagatttaagtccttgatccatcttgagctgatttttgtataagatgagagatgaggatccagtttgatccagtttcattatcctacatgcagctagccagttatcccagcaccatttgttaaataaagtgtcttttccccgctttatgtttttgtttcctttgttgaagattagttggctgtaagtatttgggtttatttctggtttctctattctgttccattgctctatgtgcctatttttataccagtatcatgctgttttggtgactatgaccttacactatgttttgaaatcaggtaatgtgatgcctccagatttattctttttgcttagtcttgctttggctatgtgggctcttttttggttccatattaattttagggtttttttttgtaattctttgaagaatgatggtggtattttgatgggaattgtgttaaatttgtagattgcttttggcagtatggtcatttttccaatattgattctactcatccatgagcattagatgtgtttccatttgtttatgtcatctatgatttttttcagcagtattttgtagtttcccttgtagaagtcttttacctccttgggtaggtatattcctaagtattttacttttttgcagctattgtaaaaggggttgagttcttgattttattctcaccttggttactgttggtgtatagaagacctactgatttctgtacattaattttgtatctggaaactttgctgaatgcttttgtcagttctaggagcattctggaggagtctttagagttttctaggtaaacaatcatatcataagcaaacagcaacagtttgacttcctccttcctctttacccatttggatgccctttatttctttctcttgtctaattgctctgtctagaacttccagtactatgttgaagaggagtgagagtgagcatccttgtcttgttccagttctcagagggaatgctttcaactttttccctttcagtattatgttaattgtgggtttgtcagagatggcttttattacattgaggtatgtcccttgtatgccaatttttctgagagttttaatcataaaaagatgttggattttgtctaatgctttttctgcatgtattaagataatcatgtgatttttgtttttgattctgtttatgtgatgttcacatttattgacttgcatatgttaaaccatccctacatgcctggtatacaacccacttgatcatggtggattttttttttttttttgatatgttgttggattcggttcactagtattttgctaaggattttagcatctatgttcatcaggaatattggtctgtagttttcttttttggttatgtcctttcctggttttggtaatagggtgatatcagcttcatagaataatttagggagggtttcctctttctctatattgtggaatagtgtcaataagattggtaccaattctttgaatgtctggtagaattctgctatgaatccatcagtcctggactttttgtttttggtaatttttaaattaccatttcaatttcactgcttgttattggtctcttcaaggtatctaattattcctgatttaagctaggaaggttgtatctttccaggaatttatccatctcctctaagttttctagtttatgtgtataaaggtgttcatagtagccttgaatgatcttttgtatttctgtggtgtcagctgtaatatctcccatttcatttctaattgggtttatttggattttctctcttcttttcttggttgatcttgctaatggtctatcaattttattttatcttttcaaaaaaccagctttttgtttcatttatcttttctattttgtgtttgtttgtttgtttcaattctatttagttctgctctggtcttggttatttcctttcctctgctgggtttgggtttggtttgttcttatttccctagttccttgagatgtgaccagattgtttgtttgtgctctttcagactttttgatgcaggcatttggggctatgaactttcctcttagcactgcctttgctgtatcccagaggctttagtaggttgtgtcactattgtcattcagttagaagactttttaaatttccaccttgatttcatttttgacccaatggtcactcaggagcagattatttaatttccatgtatttgcatggttttgaaggttccttttggagttgatttccagttttattccactgtggtctgagagagtgattgatataatttcaattatcttatatttattaaggcccattttgtggcctatcatatggtccatcttggagaagattccatgcgctgttaaatataatatatatcctgcagttgttgggtagaatattctgtaaataatcattgtttatttgctgaccttctgtcttggtgacctgtctagtgctgtcagtggaatattgaagtcccctactattattgtgttgctgtctatatcatttcttaggtctattagtaattgttttataaatttgggagctccagtgttaggtgcatatatatttagaactgtgatatttttctgttggacaaggtcttttaccattatataatatccctctttgtcttttttaactgctgttgctttaaagtttgttttgtctgacataagaatagctactcctgcttgcctttggtgcccatttgcatggaatgtctttttccacccctttaacttaagtttatgtgagtcctatgtgttaggtgtatctcttgaaggcagcagatggttggtgaattcttatccattctgcaattctgtatcttataagtggagcatttaggccatttacatttaacgttagtattgagatgtgtggtaccattccattcatcaggttgtttgtgcatgcataacttggttttctgtgtatgtgttttttttaattgtatttttgtttcataggtcctttgagatttacgctttaagaaagttctgttttgatgtgtttccaagatttgtttcaagatttagagctcctttgaacagttcttgtagtgctagcttgatagtggcaaattctctcagcatttgtttgtctgaaaaagactgtatctttccttcatttatgaagcttagtttcactagatacaaaattcctggctgataattgttttgtttgaggaggctgaagatagggccccaatcccttctagcttgtagggtttctgctgagaaatctgctgttaatgtgatcgttaatacagagtgacaacttgattgggttgaaggatgcaaagttttgatcctgggtgtgtctgtgagggtgttgccaaaggagattaacatttgagttagtgggctgggaaaggtagacccacccttaatctggatgagtaccatctaatcagctgccagtgcagctagaatataaagcagacagaaaaacataaaaagcctccactggcttagcctcccagcctccatctttctcctgtgctggatgcttcctgccctggaacatcagactccaagttcttcagctttgggactaggactggcttccttgctcctcagcttatagatggctattgtggaaccttgtgattgtgtgagttaatgttactgaataaattcccatactcatatatatctatatatctatatctatatctatctgtctatcatctatctatctagctagctagctagctatctgtctatctatctatctatctatctatctatctatctagctagctagctagctagctagctgtctatctatctatctatgtagctagctagctagctagctgtctatctatctatctatctatctatctagctagctagctagctatctatctatctatctatctagctagctatctatctagctatctacctatctatctatctatctcctattagttctgtccctctagagaaccctgactaatgcaataggttacctggtatttgtgcctcacagctcttaagattctttccttcatcttaactttagataacatgttgacaatgtgactaggtgatgatctttttgtgattaatttcttaggtgttctttcagcttcttgtatttggatgtctaggtctctagcaaggccagggaagtttttcttgattattcccccaaatatattttccaaacttttagatttatattcttcctcaggaatgccaattattcttagatttggttgttttacataatcctagacttcttggaggcgtcattcatattttcttattcttttttctttgtctttgttggattgggtaaatttgaaaactttgtgttcaagctctgaagttctttcttctgcttgattctattgctgagactttccagagcattttgcatttctataagtgtgtccattgtttcctgaaattttgattgttttttatttatgctatctatttcattgaatatttctcccttctcgtatctttttttttttccttgcattggatttttcttttgtctggtgcctccctgattagcttaataactaactaatcttttggattctttttcaggtaaatcagggatttcttcttggtttggatgcattgctggtgagctagtgtgattttttggggttgttaaaaaaccttgttctgtcatattaccagagatggctttctctggttccttctcatttgggtaggctctgtcagagggaaggtctggggctcaaggctgttgttcaggttcttttgtcccacggggtgtttccttgatgtaatactctccctattttcctagggatgtggcttcctgagggccaagctgtagtgattgttatctctcttctggatctagccacccagcaagtctaccaggctccggattggtactggggattgtctgcacagaatcctgtgatgtgaacaatctgtgggtctctcagtcatggatactagcacctgctccacagtggaggtagcagaggggtgaaatggactctgtgaaggttcttagctgtgattaatccactattttggtgctggttggcctcctgctgggaggtgacacttttcagagatcatcagctgtggtagtatggagaggaacaggcagtgggcagggccctagaactcccaggagtatatgccttttgtcttcagttaccagcatgggtagggaagaaccattaggtgggggcagggctaggcatgtctgagctcagactctccttgggcaaggcttgctgtggctgctgtgggggatgggggagtggttcccaggtcaatggagttatgttcctgggaggattatggctgcctctactgtgtcacgcaggtttttaggaaagtgggggaaagccaacagtcacaggcctcacccagctcccatgcaccccaaagggccagtctcactcccaccatgcctccccgcaacagcactgagtctgtttccaggcagcgggcgagcagggctgagaacttgccccaggctacccacctcccagctgcaaaagcaagtggggctttcgttcttcccccaccggtggagtctgcacactggtttcatgccctcccctgaatctggccaggagacttctcattccgttggaattgttacaaagttcagctggaggtttccttctccctgtggtcttttgccagtgcctctggcagccctcctcaaggacccctgtgaggcaaggcagaaatggcttgctaggggatctagtgagtccacagagcttttcctgctgcttcctctacccctgtatttcgcttggctgcctaaattgactcacctccaggtaaggtcagaatcttctcccataatctagaccttcaggctccccagtgggggtctgtgtttgggggtggacgatctccctttttcacttccacagtttgggcactcacagtatttggggtgtctcctgggtcctgcaggagcaatttgttttcttcagaggttctgtgggttctcttggctttcctaatgtattcctgcggtcattgtggagcaaaagttcacaattcaagcctccacaggctgctctgtccatccgagtgggagctgcaatctagtcctgtctcccgtccaccatgatctccccgataacaaaggttttaaaaatgataaaacagaaaacaaattattgcaaaatgtcagctcctgtaaataaatctatgaatcgagggctaaattcataaaacaaattttaaaagtttgagtggtggttttgttgaagattttttattgttgtataaaaccagtcgaaatttcttcaggtaaatattaagttacttatgcaaatttctaataacagttcatagcatacagaaaatggcctttattgcttcagatatctctgtgttaaacttcaattatggcttcagtaatagtgaatctttcctttaaattaaaacacaatatttatactatataattctagggggggtccaaagacatggaaataaaagtcataagaattgaatgaaataaaattttccttgaaaaacagaaacagaaattataatgctatatctatttgaataagagcagctaaataacagtagctaaactaaaaagagataaatcaagataactttaaagagatagcccaggctgctgtgtctcactgtgactgtgggtgttgagggccctgctgctgggagagctgagtgaaacctgctggccctgaatccctaagcctcacagcacctcacttctccttgctgggaacctgatgactcaggggacccctggtccttgtgggcctctgttggctgtacctgaagcagcaggagcaaagaacccctagtaaaaggcaggaacttgaactccatgtcagccaggatctgcctactgcaatcatcttcttttcttagctcccggagctttctctcagtggacagaactgccctccagctttcctgagctctttccacacaggcaagaatctccttctgatagaaggaagtgattctttccaattctttgctgatattttcagccatctccttgtagaggctgtgaatctgctgtgtgtattcacatttctacacacgctcagaagtttcttcttcatttctaacctgtgtgtttccaccgcaggtgatcttctctgaagttgcgctatgtgttcttgatgtgattcaggtaggatttgaagcttcagctgcaggttctggatcccacctgcaagttgggaattttcaaactgcaaagacgctttctcagtttggagatgtttgatttgtcctgtgagctcttcattcattgattttttttcccacaattgtcaagctatttcttgatttttcttgactttcacagaacacatttaagtcaccatcacccaggacgctcttcagatggccttctgactgatagttgggcgggaggggctggggcaggcagtcttcattttctgctttcctctttagctgtactttcgagtcctcgtcactgtggtccctagagaaatctcccaactgcatggtgtccagcaggttttcagccatagattttaattggctcatggtatctttcatgacctgttttatttgtgcattcaaaggtttccagcttttctttctctccttcctttcctgtactgtctgcttccatcttgcaatttcttggtcgagcacttctggactttctgctaaatgagtgttttcattcaaactgttatttccttctgaagtttttctccatccttctttgatccttttaagatgtgtcctgaatcagtcacttgagaacatttaggagactcacttttccatgctttttccagaaagccgcctgtgtcctgcagggaagacctgctcagatttgtattaatgattgacaagcagggggattgtaatatttaaggtctgtggcaacttgagggcttcctgggtctgtgtctttagcccagtgttctgcctgccttctacatggacctcctgaagagaacaccttttgttcagctcttttcctcttcataaagtgccttgtttcttaataattaagaccacacagcagtacaaaccaggatctcccagggagccctggggtttatctcatgatctcagccttcaccagctctgtagccccagcagctccagagcagctggagagacatttggggaccagcagcccctctgtggctctgcctttgcttgccagtggcctgtgggccacagctgcctactcggaaccctgcggagtgttctgtctctaatgctcacaagtgcctggcaaccaggatagaagatcagttgtgctgggggaggggagccagccaggttgtagaaacagcatccctgactttgttctgctaactgtgcagagagaggtgatagtctccgcccaggccatgagggacctggaaatggctgatgacacggtggagctcggccacaccaggcccagctggccccacagcaaaccagagggtccaagtgggtccatgccctgtcccttcctgtccacaagggcctctcaggggacagtggtggggcccatccctgggtgaggctcagtttcctgatttcaagtttccttccgcacagggaagctgggtcctgcccaccaaggtcccagggatcctcctctgaggccccctctctcctttgggtttagtcaacggagagggagatggggagaggactgaaaggtctccccaaaggtacaagctgagagacctggatttgcaatgtaagaacccaggagaaataagtggaactgacggggtctaaaatgtcacggctattctgtaaagcaggtttgtccctgttccatccaagtgtcctgagtgagcgggactctgcttcgagggtgtcaggttgaccctggctctttcccttgtgtggccctgctatctttggtacatgcctcccaaggtggccctggggacagtctccaatccactgagtcatcttcagaagtctgcatgcatctgcagaggggcaggtccttctcagcctggattccactaaacctcttccccggcagagtcaggctcagagcctcctcgtgcagccctggactctgccgggagcaattagtctcagaatctcgatctgagagagaagcgagcgaactggcagctggggccagtctggggtcctaagggtgttggggttccagaccctcacaggacatagaggggcagtggaagtggccctcccaggagaagtcagatcccttgcagggccgcaggaccccaactctgcaagggcaactggttggtcttttaaaaggatcaaaatgtgttgaagaaacgacagtaatgcctagaacaccaacctggcactaaaatgagtgaaacagagttacaaccagggacccgaggaagatccaggatattttgctgagtgaaataggaagatgcaaaagcacacatgtagagaggaatccacaaaaatctcaaaggacacgtactcactccctcctttgaaagcagaatttgaagaagcaaagaggagctgctccctgagcttctcgcatctcccttctcctcccttctcccttctcctctcccttcctctcccctctactcccctctcctggcttctcctctccacttctctcctctttcctcctctctcctctcttcttcccttctctctcttctcatctcctcccttcccttctcgcctcccctcttctctcctctcccctcctcttttctcctctcctcccttcctccctcccctccccactcctaccttcctctcctcctccctccttccctttttgcctcctttcccctcgtctccccttctctcccctcctctcccctcctttcccctcctcctccttctctccccttctctcccttcctcccctcctctcctcttccctcctcccctcttcttccctccactcctcccctcctctccccatcccctctcccccctctcctcttccctcctctcccctcctctcccctcctcccctcttcttccctcctcccctcctcccctcctctctactctcccctctcccctcctcccctcctctcttcccctctcctctcccctcccctctgccctcccctcctctctcctcctccactcctctctcctcttctttcctcccctcctctccacctccttccctctgtcctgtactctgctctctcttcttccatgttgtcttttcttatatgtactttaaatatttttgattttgttaatacaagtactgtgtatgcaattcatacctttttagcagacagctcacatggacccaagttggggttaacatgcagattgtgcaggggttccctgcggatgcacccctgtgtgccctgatgtggacctgctccttcctgcttcctgggctccagacagaaacaccgtacccctgcaccagcctctgcctcagctcttcacagtcagcacaccctccgcttcctgtcagggtgttctctgctgagtctggttatgggatccctttctgtgcagagccatgctcccgtgtcactgtgtgtcaccttcaagctgtccccgtgtgtatgcctgtgtgagaatatgtgtgtgtgggtttgccatcgaaggaaaacctttattttggctgctaacatttggaaacatttagagaacaaacaatatcttttaaaaaacatcaaaggttcaaaaaaacaagacaagaaacaaactgttgtaaaatttcaactcctctaaatttgtcttaaattgaacttagaactaatctaataaaaatagtatgaagtttcaatggtgtgttgttgttgtctagtattttttggcattgttttttaaaaaccagtcaaaatttattcagctaaatattacattatttgtacagatttataataatagcttacagaagtgaactttattgttttccatgtttctattcatgtccaattttgatgacagtttaaatcatagtggacctgttatttaaatcaaaatataatacttatgcatataattttagagggtccaatgattttgaaataatgtattcataagagctattttaaataaatgtatatttaaaaatacaattttagaaattatagtactataaaacttcagaaagagaaattgcacatcaattaaataacagtagcttaactagaagataaatgaaaattacttttaaggacgaaaacaaacaaatcataaactctgagtgaaacctgcaggtacccctggatccctgagcctcacagcacctgcctcttccttgctgggaacctgatgacccagggggcccctagtacttccactcctctgtgagctgcgcctggagcagcaggagcaaaggggctgcttgggaaaggctggaacttgaactccacatcagccatgatttgcctgttgccatcattttgttgttttagctcatggagctttatctcagtcagcagaactgctgcccagctttcttgagctcttcctcatagaagagaatctccttttggtaaaaggaagtgattctttccaattcattgttcatgtcttctgccatcttcttgtagaagttgaaaatctgctgtgtgtagttcgtatttctgcacatgatgggaaatttcttctagatttctaagcatagaggaacatagtaatttaacagggagatacagagtgaacacccttttaatcaaatgataaaatgataaaagttaacataaaaatattaggacaagctgacatcatgtacctcctgatatgatgcactgaaaagaacacaacattatttctatgattttctgccaataatgcataacctgaatctaaccatgaagaaatagctgagaaccccaagttgaagggcataccacaaggtaacagcccatattcttcaaaactataaaggtcaataaaacgtagaaaaggctgaataattattttggaattaaggagacccaggggatgggagagccaaatgcaatacatgatgctggattctaccctggaccagaagaaaactagttacagatgaaattatttggaagactcacaaaatttaaatatggacaatggattaggtaaggattgtgtcactgttaaattccagttttgatcattgcattctggtcaggaaatgtcaaaatttagtgtcagtgggtttaataacttcaacttatttcaaaacaaagagttgctaaaattcttcaaccatgatcccttcctgacattgtggtcaagctatgtatggctcatggtaggtctcttctcattttctggtggggtacttaatgtgaaaacacagcaggtaaaaccatcataaaacatcttcaagttctaacttccttgagtctacctatgtctgagagtgtcctccaggacatttcagggaatatggagaacgtattacttgtggatgtccttctccaatcaagtccttcaatccttctgttcctcctgcagtcttctttctggccagtatgatgcctgaacacactctgagtctaaagagcttctggcacctatgttctctgctggcttccgtgaaaagctctctctttaaatagccataaacctggtagcttaagacaactgaaatttattattttatagtcctctagacctaaagtcccaaatcaaggtgccggccgggccatactccctctgaagtctctaggaaaaggtttttctttgctccttccagcttctggttgctgtgagcaatcctgtcattccttggcttgtggctgcacccctccattctctgtctccatcttcccatggccttctctgtgtgcttctctgtgttctctaatctatggataccaatcatgaatttagggccaatcgcaatacagtaccctctcatcttcatccttaactaattgcatctgcaaagacctatttccaaataaggtcatattctgagattccagatgaacatgaacttttgggggccattatccaacccactacaccagtcttcactgcctcaatcaatttccatggagtttctctggattatttgaaaacccctagcttggttttatttctcctggattccaaattttccctttgaatagggctccttctctccacccacaacttagaattctcttctctctgtctcctgttcaacttcctttttctttattctgtatctcacagagacaggcggtatccttccatacccttccttggctcccaggacccacacctgttaaacatatgatgtgtctcatatgtggattctacccaagatcctacagaggaaagatttgctgggactgaggtacggtcctaaagagtaagtcaagatcctgctcacagactctccaattctcatggaggactgtggcttgtcaagtaactcagaaccactgaatttttctgttcaaccctattctagttattttggctctaagataaagaaaaattaattacttgcatatttgatcaactgaaaaaatccaggctgtatgttttgagtcctgatcaattaggaccacttgcctaaaggaaacaatttaatgatttccttcactttaaagttgtgaagaaattctggctgcctttctcattgcatctttatgaaggccagactttatgaaaaaatagtgatgatagcaataagtctggaacttggtaatcgacaaagctctgctttcgtgctaagtctcaggagagcttttcagtactctatgaagtatggattgggcagatcatcctgccagcattacagacagacgaggagacaatcatactgcttttgttcttggactggctcatagtttgggcacaggcatgattaatttgttcataccattgtaagactcttatctctaaaagcacaaagagaacacatcagaagtagatctttacatggaacaaaaccaactaaccattttgcccaaggagcgactttctcatctgttttttttctcatctgtttttttctcagtttccttctatttctatttaaaaggcaagttaaaaaaaaaaacaataagatagcatagtagtggaaaatagctcagcccttacagcaagacatcctaggctgaattccatttctgccacctactaacctgatgaacttgggtaatttccttaacctctctgagcctctgtttattcacctgtgatattgtttggctctgtgtccccacccaaatctcatcttaaattataatccccacatgtccagggagggacctggtgggacatgattggatcatggaggcagatttcccctttgctgttctcatgatagtgagtgtgttctcatgagatctgatagttttaaaagtgcggcacttccttgctctctcattctctctctctcctgctgcattgtgagatgtgccttgcttcccctttgctttctgccatgattgtaattttcctgaggcctccccagccatgtggaactgtgagtcaattaaacttcttttctttataaattacccagtctcaggtagtattttcatatcagtataagaatgcactaatacaacctgtagtgtgaacctcaaagtcaagttgagaggattgaagaaatgatgtagattatgtaccctgtgtgacgcctctcatgttattcagtggtagttggctccctctccacaccttcttgggagattctaattttgtcgaaggatcagtcctagatcgcagtggcagtgctgacattgctgtaaacttcaggccaatgtggcagcataccatctagccatattgcaatggagaggtcatgcaggggtactgtatgaatcagtgcccagagataaaggggtggtctgtcctctgctgcaaagtaggacaatgcttggtctccagctcttcacctcctggaaactcacccccgttttgtgcttgaattcatgctctctgaacaagagaaactcatgtcatctctctcatcctgtaaagcactgctgagaacaatcatgctaaaataatttagagagagaaaatgttaagcaaagactgtcaaaacaatactcaagaataccaataaggaaggctgttttcagttagcaaaatctccaactaggggagattaaacagctcttacaaaagtgcgcgttatacaactatttcatcacacgttgagagccagcatctcaggatccagccgtgaaccaacatctgaaataccttttcccgtaatccccttcatccaagaataaacacttttaatgaaagtcccaagaggaagtaaaaaagaatttgtttttccagtttcttttaacaatctttcctaaaatagggggctattcttgtttgcaccttccttataacagttcagtcaaatgtggccactgctacagcttctagcaagttccctgggtgcagagaattgggaactggcacctgcaagacaagcaggcaccaggattttgggggattttaatttactaactactctttatccttttggtgagcttgcatttcaaaccttgccaagagacacatctccttgaattctgctgtcctgtctcaatgtgaaaggcttaagaaggatcattttgttatttcaaaacactagagcaaatacttccaagactgtcttgaaaagttctttggaattaacatcaagcacttactatataatgaaagagtcatgcatatacgattgttcttttagctgaggagtgtttggtagtaataatgggaacagaatttgagagccagattctaagcaggaatgtaataacagacttgaagataaaaaaaatatggctttcccttagcaggaggagttgttgaaacctgaaaagctctgtttatggttttaccaggagcttctaacatcatgtagaaaatggatgtacaaatgtaattaaacacagtaacatgaaactgcatggaaaatttggcagggaatcatatttttttcctgattatataagtaatacacatgttctttgtggaaaatatggacataaaaatatggcatgtagaagaaaattaaaattatacaattataccacaaaatcattttctgatgtatatatattatttttctaaaaaattgtatttatgccctattcatatttgtcctgttgctttttgctttatgcttaatttaatcatatctttatattgtagtatgtgaacggctatctccctaggacacgtattgcaaacattgtttttctttaagatctagagttttatctgaaacatttatttgaatcttgcaatccactccaaaacatacccacatttgttttactatcaaatatgtagcatataaatataaaatgtaaactgcattgtagataagtaaatattatgtacatatagacataaaatataaactacaaaattataatatataaagcatatcaaaataatattaatgaaatgtatgaagctgtacataaatgaaagatgctatgtcctctttaaaattttaatttcataccatttaaacatatctgcttaccacatgcgtaagaatttctttgcccaacttgaaatagcaaccttaaaatattctatgtcactggaaaaaacttgatggcaattttttatatacaaccccacatgcacacacacccacacgcagaagaacaacatccatttagggactccttggacaaaatttcaagtcttgaagaagtaggtttactcaagcaaaactaacctcctttccaagtctggaataggtatgagatgtcctttcactagatataaatttatcaatgtacagaaaaacaaaatcgatgggtctcaatttttcactgtaaaatttccttccttaaatttcatacagtttgggcacctgttgttccttgttggcctgtaagaaaatgagtcaccatgtgcaaaagatgagccatagatctgttcagaaatagtcactcatgtttgacatgacagcttgttttccatatattctcttggttgttattttacattgcatacatataataataaagtcatattttctcccagcatggctttctaagtggagttaaatatatcaatattttatatcatacttcacagagtgtcatggcttcccattttgccacctgatccagactgacagtcaccgctgtaggggaccataccatatacttaggcatgataaaggcccataggttgaaagacagagaagcatccctgacccagtaacttaccatttactggaggaacgagcccagcctaggctgaagagctagttgaggaggtgtctccaccacccaactcaacgaagtctaacatttcacagctagatcatcattcctttggctttaacctgcagaaattgtattgcttcccaaaatgcatatataagagaggtaaagccatacaatttaatcagtcatctgcaatcgtgtttctccaaaaggggtggccaggctgtctgcatcagtatcctggggtagggaggaggagggtggatgattgattggagatttctgagtcccatcatgagagattcttattctgtagatctgtggaggcctctgggagtcttcattttagcaaacattccaggaaattcctgtgaacattagaatttgagaaccaatcatttatactctgaagtgaatgtacttacgaatccttccttgagaacagaggagttgcttactaatctctggggcgaattcagtgaccatcactaacagacagaaagaggaatctggacaaagcacaggacaaacctcactttttctggagtggtcatctattaagtgctttcttggagagggtatagtaattgtatatttcatataaatacactgtagaaagagaaaaacaaatatttagatatttgtgtccccttctgattatctacgaagggatttacatggcacaaattaaatctatccactcaccctgaagttctgtccttccttcaagcaggagccccagcagagtggcccagggccagctgtttttaagcagcctctgagagcaacacagcaggtcccacccaggagaccacagagctatggtgggggaagccacttacctcctgtatgagttccctggggttgctgtgacaaaggacactgagagagtgtctcagataatggacattcattgtcacacagttctgaggctggaagtccaagatcaaggtgctagcagggttggttccttctgacagcaatgaagaagaatctgttcctggcctcttttctggcttctggtagccttgggcattccttggcttgaaggtggtcatcttcttcctatgtcttgaaatcatcttccctccatgtgtctggctctgtgtccaaatttcctctttttgtaaggatagtggtaatattggattagatcccaccctaatggtcttatcttaaattgatcatttgcaaagactatttccaaacaagatcttattcacaggtactggagattagggcttcaacatcttttgggggtcacgattcagcccatcatgccccctcttctcaggtctgtctgaggcttgctgctctgtcccttagtggctggggacagcatgcttgcctatggccatgcctgtagctccactttgctctgagaggctgagcaatgcctctcatcagtcttcccacagccccttgagtggcccagcacctactcagtgacccatagggatccggtagaaggagcaaatcacagcaaggccataaagaatttaaagcttaacccagatgctgagctgggatgcaaagcaacaagctagaaaattgacaggcaggccccaaatggtcttgcagagtctaatgtcatcaggtttctctgtgatgtggcttttattaaacacttcttaataatttgtgttattacttctgagcttagaaatgaattatactcattctctggaaatatttttagactttgcctctaggtcatgaccaataaaaggtttaaattcaaatactgaatgatccaagggctcacttcctatagaaatatcttcatctatgagaatgataatagtgataacagcaaatatccatggggtgccataatttataaaaattatgtgtttttacaagaattatttacttgtcacctcagaggaaactcaaaaggaatatgactattagccctcagcggaagctgaaatgtatcacctatcgtaaggtatctagtctatttcccatgatgtttactttttgtgtccgagaatgttgcatactctcattcaaagtctttcccagaaaggaccagttgataaagccactggctctttccagcatcacgcctgtactgatgccacagtggacagcctttgatgccacaggaccacagctcaatctcctgattgtgaggagaagagtgggggtgttctcactgccccagggcattactaaaacaggtttgatcagcaagacattaaacaacagagattaggcttaggaatctaatatgccactatgtgcttactgttgtccaaatattaggaaacacaatcccagatcagtgggttagatttgtgttcaaggggacaagttggaatgtgatgccctcacttcaggtgagctctctttacttgaaacactcttaggtttactggaaggactcattctcgggaagtcacgctcttttttacttaacgtctttcatcatgttaaacatttattttatattctctttcagattggcttcttattaacccagattactgaggttctaattctatttattttgttcccgctgacccttaagtggagtatattgtgtcctggtatatttttatataccaggttttatatttgcttctgctaagattccaaagaggcatgtttgtctgggaaaatctgcaagctaatttcttagctagggaattcctgaacaaagaaggaagtgaaaatctgagccccaactttgtgtttggaaaagggctgcactaatggattaggagattcctaccttcacacctaaaccaggcagaaagggatagacttccctgttgcaatcctgtgctaatatgcaggtaattttctggtcttaccttcagagttctgtcctaatggaggaaatctcacttcccactcttgctttgtatggttccgagacctcaacttctgtccatgtatggacattgaaaatttaggtttctggctggcatgttggctccatgcttcgggaggtaatcccactactttgagaggacaaggaaggaggattgcttgaggccaggagtttgagaccagctgggcaacaaagaaagaccccattgctacaaaaaatttaaagaaattagctgagcacagtggcatatgcctgtagtctcagctactctggaggccgaggcaggagtatttattgagctcaggagtttgaggctgcaatgagctatgattcagcctgggaaacagggagagaccctgtctctataaaaaaagaaataaaaattagtcttatatgtttccaaagccaaaatccactccattcccacctgcaagcattaggtcacatgtttctggcacctcgattgaaagcatttttttttaatgctatacagcctttctaaacatttgcagcatgaacattttcaggttatccagattgttgtcacactgaccacatactctgacatttccacatcagcatttataacctcacctgggctgtttttttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcgtgagccaccgcgcccggccacctgggctgtttttgaagctgaactcaagaatatttccttagattcagcataaagaattggagagccaaaatatgaaatatatcctcttctaagaaatactcctaaaagtaaagttaacacctcaggtggccctcttggtgttctaaatgatgaatggcatatctgtatttcttcaattagtccaccaataccaaggcctccgttttctaggaggacttgggcacagaaccatggtactgcggcttacagcagcaagtgcagtcccattaacaaccagcagatggcgtaagtataaccatccccgagggaagggcccagcgctcctgagataggaaaggaggaagtcgtttattatttaaaggagagtttgaggacggacttgagctgtgtgaaatttgagatattcagggaagctgatatgtgttaatctgttccaagtaacacatgaaaatatcttttgccaacccaactctgtttactgttttaatttcctcaaaagaaaaaaagaagtgattgtatcaacagtgggacaggaggaaaaacaaggaaaatatccaaaggcagggacagaagtctgcaggttatattaataaaacattttaagcaggcaggtctttctttgaaggtgaagcacctttcatttgcttgccactctgaataaaaattacccctccaaacacaaaataaacacaacatttaccatgccctgccaactttgcctttgcatggagttaccatggactttcctcgttgtgaaaggaactccagccccttctgaaccttcaactgcaactctgagcgggtgagagtgcatccctactttccccactgttctggggtatggtaagacaggcttgtctaaatcctgtcgactccaaggacttgtagaaattccttgtgagacaagagtggtttgataaataattctaccacaaagacacgtgcaagggaatgttcattgcagccttattcacaatagcaaagacatggaatcaacctaaatgcccatcagtgacagctcagataaataaaatgtggtccatgtataccatggaatactgtgcagccataacaaatgaataagatcatatcctttgcatgaacatggatgaagctggagaccattatccttagcaaactaaccaggaacagaaatccaaataccacgttttcagttataagtgtgagctaaatgatgagaactcatgaacacaagggaacaacagacactggggtctacttgagggcacagggagggaggagggagcggagcacaaaagacaacaattgagtattgggcttttaataccttgaagcagaagttaaaaagagaaaaacgagttttcctgtacttacttggctgactcactccaaggctagcagtaggcagggccctagtggggccttgataacactatctgaaaagccagagcccaaaggaatgagctccagagactctcccaacacctcctcccccaagcaagtataagaaaaactgtttcttcgtatcagtttccccctttgaaattctttccctataccattatcctttgatctgctctcacaactacttttgtaactatttctgcaagtttgcaaggattttgtaagttcttgttttccagctgtgccatatggtgaaggtcacaagacaagcctgagttgtaaaacatgtcgctgtttggtaaactgcctttgttctgcttctgtgaagcttgcttgcccgccctgcaggtttcacgccactagctggccaactcccttcagttgcatgtataaaagtcaagccctgtctttgttcagggctcagcctttggatgttaatctgctgggccagtggccacctaaataaaatcttcctgttccacccattggtctctcctgtcccttaattcccacaacaacctgagtgatgaaataatttgtacaagaaatccccgtgacatgagttcacctaagtaacaaaccttcacatgtacccctaaacctaaaataaaagtttaaaaaactttatggtttggctacctcagttatcaagggtctcatcctacctcacatgctccacatagcaacagagaggcacccaggcacaggagcacacatgccctcaggtgcccacatgcactacatggagggctgcttcagtctctccttccctcagcaccagcatcctgggatttcccagaggaaaaaaaacgggagccagtctgagtggtcaatgttgaagcacagagggttcagaatggatttgcacaacagatagctctgtgtctaggaatatcctggtctccttcactcatggcccaggtcatctggcttttgggatgaggggtgctacatgacacacagggcaggatgtcaagatgaaaaagtccagtgtagagtttagtaccagaagagagaaaaaaatagaaaaaagtgtacagatcagggtgtgatgactttgatgatgaccatttctttgaattgggcaggttggaaaagaaaaataagcattgggtggggcaagtgcaggttaatctgggagaatgtggaaaggcacaatacaaagtaagagactgtatgttgatccctggagatgttcctgaggacacaggggatacttcattagcatgtaggctcagtgatagaaaggattcatcattttgttgcagaggaaaagttcattgctgtgagatgtccagttttcataatatgaaaagagcgtatgacaatgagtattactactcaatgatgagtaatatgtttttatgaatatgcatgtgtaaaactgagttttttaatcattatattgaatgtggttttccttactccctcttattgctgcaactctttgtgaaagtgatgcatttccctttatgagttactgattcaacaccctcttgtccagtttgtcacatttttctcatttctggactcacagttctaattcagttttctcctggggtttcaacatggttaatttttttcatttgctcctttttcacctttgttttaaatagtggtagaataaatcacacaccttcttgctttgcttgaaaattaacttttgcatcttccagtcaatagaatttttgtttaggtccttgaatacagattgagaaatgtaatggctaagttaccaaaatcaactaaattcaggtaaaacatttttgttttaattccattaagtcttgtttgggtttctttttctttgcataggtattaataatacttattctatttccagtctaccattgataaaagataaatgcactttcatttttctgaatacttctatttaggaaaacctactaaatgtgcagtgagtaattttaatattctattgaacactcactaaaattgcagtgctgagtatgatagttaaatggagacccagaggagaccccatctgtggacagttacaattgtacttagaccattttcctaactgggctctcctttagttccaggatacaagctgaaagtaatagtaataatctactctttagatttaatgtgaaaaataagggcaaatgtttaagctcctagaaatataaagttgtccaggtttttaatgctaactttggtcatttaaaaataatttgcaagacagaatcccaaaccagctttcttactagtgatagggcccaaactgaaaaactgctctctgctgatgcagaagcagacaggctcaccttttttgatcgaagtgagtggaaactcccctgaaaaaggaggtttttaagcagcaactaaacctcagcccccaactgaaaaacgctggaagatcagggattcctggaggaaagaggtcctggacttcagcaatcgtcctattggtttaggctacaaggtgcccaagccagcaccaggcaccaataggcaagctgctgcaggccaggtcaccttcactcaggatccctttgtggttaccggatgtcaactgaggaacgtgatgagacaagtctcagtcattttatgagatttattcaccaaagttaaggatgtgtgtccgcaacacagcctcaggaagtcctgacgacatgcgcccaaggtggttggggcacagcttggtttaatacattttagggagacatgagacattaatcaataaatgtaaggaagtacactggttctgtccagaaaggtggggacaactcaaagcagggaggggacttccaagtcacaggtaggtgagaggcaaaaggttgcattcttttgagtttctgataggcctttccaaaaggaggcaatcagaatctgcatctatctcagtgagcagaaggatgactttgaaatagaatgagaatcagatttgccctgagcagttcccagcttgaaggggcccaagatatcttcctttcacaaagtcttaatagaagctgaaggcttcagatttaacccaattactgctgttaaacattgcatacaatggttctcaactaggggtgattttgacccccaagggacatttgtcaaagtctagaaacagtttggtgataacagctgagggaagggatgctgtgaaatctagttggtaaaggccaagggtgtagcattctgaaatacacaaaacagcctcttgctccacccaacaaataatgatttgacccaaaatatcaacagcaacaacactgataaatgctgctacattgaactgtttttctaaaagtactaagagattaaaatttatatcacatgactaatttatggggattagaagtttttaagagctttgttaagatataattcacataccaaacaattcaacaattgaagtatgtaatacaatggtttaagtttgtttacagaattgtgcaattgccacattacgttctatattttaatcaccccaaaaagacaactagtacattttagtcatcatctctccatcctccctctgcttcccaccgtaagccttagcaaccattcatctactttctatctctatagttctgcctattctgtacatttcacattgatgaaattatacagtatgtggccttttgcatcttgttctagcataatgttttcaaagttcatccatgttgtctgtatcagtatttcattccattttattgccgaataatgggatttataacgatactgctgcagaaatcaggagaatggagagaccactggatggaaaaggaggattttattgagtgcactcagacccggcggattaacatccaaaggctgagcccttaacaaaggcagggcttgacttttatacacacttctgaaaaggggctggatagtttgaaacaagcttatagtggcgcaaaatgcagtgacacaaaagcaggtaacaaaggcagtttatgaaacagtgacaggcctgtaactcaggcttgtttaaacacatcatgtgactcctgctatgtggcccaggtggctgttatctaggcttgcccaagcttatcttgtgtcctttgctgtgctgcctggatggaaagcaggaacttacagaaaccagccacagaaaacaggaatttgcaaacttacaaaacttgccagggtatagcagcacatggggccggggcaggttggggggtgatggggggcagggcttcagctgcctaaaagaaaaaaaaattgtttttcctctttttaacttctgcttcattaccccctttgatgctttttataaatgaggtttaatagaaagaatcattattatttaattcttcatgtgaaggtagttagctctttatttggcaagggttaatatttagttagagccattagttgagtggcagtttgtttctctacaagagcctctgtagctgtttggatgttcttaacaaggagaggtaggagacaagggagtatgaggcagactcctagtatggctaaaactattcctactaaggttttaaatcctctgagggataaaaaccagcccccaaagagggaatctgaagaccatcttttccaagcctggaatggaacatgggctaatttttggatttttgcagttatattcttgatgacctttccattgtcatcaatctctaggcagcagttagttaaactgaactttccacatacccctccttcctcagctagaaggtagtttagggctaatctattttaataaatagcattccttatttttgtggcttgctgggctagcagatttaaggcctttactgtatcatttgtcataattttaagtactgcttgtaaccttatgatgtggttgagcatgtaaagagttgtgtggtattccctacattccaccttctgcccaggtggctgggccataatattggattattctttcagggggccattaatcgtccttgcatttccctatggttatgccccttttatttctccttttagtttcatcatagacagggtaccctaaggcttctccttgttttaaagggattagaaagaaagacggtctaattgttcctagtacacaggcccttggccatttaactggcagttgccgatatgcccacagtccacaaattcaatagaggccggagggtgcctgtcaggcatttggagcttcaagttggtaccgagagtagcatatttatacccagcaagggcaaaagaggtctttaccctggggaggtggctgagcaaagtggcaaaacagcagtaaaacactaatattataaggaaagctactggacttaagatttctaaccatattgacttccctgatgatgactcgagcttcggccatgtgtaaactagtcagcttccagggtgactagagcagggctgttgcctcctcaagcttcggccgtgcgttgactggtcagcttctggagtgaccagagcagggctgtcattgtcttcaatggcaatttggtcccgtcgtaggattggccagcacagatggtctggatcctgttggctggtccattcatctcaggccgctggcttcagctgactgtggtggatccatggtacaattactgcaactgtaacggcagagtgagtgggcaagattacagtatggggcctatcccatatgggtctcaaagtggttggattccattttttgacccaaatagcatccccgggtttgaaggggtgtgccaggtctgtcaggcttatgggcattctttcccatacccagccatagacacactgcatggctatccctaaagcctgcatttgccttcttaaagttagttcccctagttcatggagatcacccttaacttgacctataattggggttgccggccgaacaagatttcatagggtgaatacctggtttgtttggtgggggtgcaccttactcagaggaggaccatgggcaagacctgatcccatcttagatgggtctcttgacaatattttttttagtagcgtttgagtgtccagttcatgcactctatgttttttgagctctgcagctggtaggctgtgtgtaatttccattttatttttaatagccataccagttcttgaactatttcagctacaagtgctggtccattgtctgacccaagagttggggcagtccaaatcttgggataatgtctcttaacattactttggttacctcccgtgctttttctgtttgggtggggaaagctttgactcatcctgacaaggtgcagaagagtactagcatgtactaatagccccctgctcagggcagctttgtgaagtccataagcaggttttcacagggtgtggctccaatttcctaaattcccaggggccgagtaggttattatgggtcattctgagcacatgttagacattgcctgcacacagcttgggtgagggcattgagccgtggcacatagaggtggcatcccagtagcgtttgtagtgccgttttccccatgtgagtctcttggtggaattgttttacaaacttaggggccaccatttcagggatggctagtctcccatcagagaatttccaccatcctccttcagtgcattttccagtttcttgggcaaaccaggccttctcatttggagagtaacttgggatctcggggagggaaggttctgggaggagaagcatagctaaggattccttttcaaagtgtggagtaatcattgctgtccgttttgcctccctgtctgcctttctgtttcctttggcctctagtgttcttgctttttggtgccctctgcagtgcataacagctaccttctttggggcctatacagtacctaagagctgtaaaatctcctctttgtattttatttctttttttcccagcagttaagagtcctctctccttgtatatagcttcatgaacatgcaatgtggcaaagacacacttttgtctttgtgatttggaatcagtgtaaatattgacctttttgtctctcatcagcaaaagagcccttgttagggccattagctctgccttctgggctgatgctccggtgggcagaggctgagcctctatcactgagtccaacgttaccaccgcataacctgcccaacggaccccttccagtatgaaactgctcccatctgtgaactacttaacaactgggtccctgaggggttggtctgtaaggtctcccctactcaagaatacttcatctaccattttcacacagtcatggagtggggttcccagttcaatcaggagcaaggtggctgggttaagggtgtttactgtttctaaagctatgtggggatttttgcataggagtccctggtactgagtcattcctggatttgataaccagtgatgccctctctggttcattagagttataactgaatgtggtaactggatggtcagctgctgccctagagtcagtttgttagcttcttgtgccagtagggcagtgacagctagtgtcttaaagcaaggaggctaccttagtgccactgagtctagttgcttggataagtatgccaccaggcgatgccacaatcctatgaattgagtcaggactcctacagccattcctttttgttcatggacatatagaaagaaaggctcagttatgtcaggcagtcctaagactggggcctgtgttaaggcttctttgatttttttaaatgctttctcctggtcagcctcccagaggaggggttccttttctctccccttgaatctggccatgttcagtataatagaggggtccctgagtttcccggggaggcatctgcaaagcccaggcatggccagactggaggcagcaggcttgatcatcctgactttcctccttgacctggggcagtggttttgatttttctttttgaggcaaggcccagggttcgttaccatttgaatttgactcctcgggggctggccttagtaaaggcgggtagattggactgtagggaggattcctatctcctctggtgattcctgcagaactggtttttcctgtggctttccctttgtttctgtagctgacagcgaagctgatttttctttcactttaagcttggcttgagccacgagtgttttgccataagctgtcaggcagagctgcaaccacgcaggtcagttttggactatatgtagccatgagtcaatataaggaaattggtctggatgccctggctgtcctcccaacccagtcaccaccttaaatacatggccaattgtttccctatctatagttccttcgaccagccatctcacaccaaaagaggtccattctatttcacagagagttctcaacctctggggggtcaacttgatcccacaacactctgcataacttttcttgaagttctttaacatacattgtaatggggtgggttttgacagcttccttcccatttcctcccagttatgacacaacttattcactcttttactttctcttcagactgattagaccatctccctcatgggaactttcagatgctgcttagctttaatggagggttcatatgagtcccaaacctggaccaccacaatcactgaattgtggggtgcctccctaagccatatgtggtagccccggaggacgtttgccactagtcctggttggtcccacactttgctaggggcgtatggtctatgctaagagacctgtggccccacacacttcactccccacattgactccttttagaactgcctctttcacatgcattcacacacttccctgctccccattccttttctctgggtggggtgtaggtttcatccgactttgtgagccactcccacatcctgggtcagactactcagtgcacccctaggagttgatcaggctccccttctgtccttatgggatgggtcctgtcttgggccccaaaccttaccacagtcctgtggcgcactatccctgaaatcatcctgtaatcccttggattctgttgcgctgtcagggaggggtactggatcacggaagaaccaatcccttctctgggtttaagttccccgatggcatgcctgaggtcacaggtctcccccagctcagggccccagacccacaggcaaaggagacagcaaacctgtcatctccactcctggctggttcaccaaaatattgcaggaatgaggagactggagagactactgggtggaacaggaggattttattgagtgtgctcaggcccagcagattaacaaccaaaggctgagtcctgaacaaaggcagggcttgatttttatacacacttctgaaagggggttggctagtttgaaacaagcttacagtggtgcaaaacgcagtggcgtgaaagcaggtaacaaaggcagtttatcaaacagtggcaggcctgtaactcaggcttgtttaagcatgtcatgtgactcctgctatgcggcccaggtggctgtaatctaggcttgctcaagcttatcttgtgtccttcactgtgtcacccggatggaaagcaggaacttacagaaaccagccacagaaaacaggaatttgcaaacttacaaaacttcccaggatacaatagcacacggggttgggtggggggtcggggtctcgagttgcctaaaggagaaaaatttgtttttcctctttttaacttttgcttcaataccacattttgtttatacattcagcagctgatgggcatttgggttgcatccactttttggctgttctgaagagtgttactgtgaacattcatgcacaaatttttatgtggaggtatgtttttatttctcttgggtatataactaagaatagaatgattggatcatataataactctgtatttaatattttgagaaattgccaaaatttttcttttttttaatgttaccacccataacgtttgaacattccaatttctttgcatccttgccaacacatgttattatctgtctttttcattataactatccttgtggttttgaagtagtatctcattgtggttttgatttgcatttccctagtggctaaagatgttgaacatcttttcatgtttttattgacaagttgtttctcttctttgggtaaatgtctatttagatccattattgttttttaaactcagctatttatatttttattgttaagttgttaaaaattcttcatgcagtctggatatgagcccattatcagatatatgatttgcaaatattttctccccttctgtggattgtcttcttttcactttcctgattgtattatttgcagcacaaaaatgtttaattatactattgtccaaattatctatttttctctcttgtcagtttttttttgtttgtttttattgtcatctctaacagcagttcacaaagtttgctttcatgtttcctctcaagaatttcatagatttagctcttctatttaggtttatgacctacctcaagttaatataatgtccttagtgaattatcttggcactacttattgaaattaagtagtttacttttgggctttcaattttattctattgatctatatgtttatccttatgtcaataccatactgttttgtttattgtagctttgaaataagttttgaaatcagtgtgagatcttcaatttagttctttttcaagattcttttggctactctagttcctttgaattcccatatacattctagaatcaccatgtcagtttctacaaaatagccatttggaattttgataggtattgcattgaatgtatagatcaatttgatgagtgttgctattttaacaataacaactcttccaatccatgaacatgggatgtctttccctttattttggtcttttaaaatttctttcaacaacgttttgtagttgtacaaagtgttacattacagcatcatagtattcactgtgaaagtcttataatttttcattaaatttgttcccaagtatcttattctttttggatgttataaataaaattgctttcttaatttcttttcagattcttcattgctagcctataacaatgcaattaatttgtgtatatttatcttgtataatgcaacctttctaaattaatttattctaattattaatagtagattacttaaaatttctacataccaaattatgtcgtatgtaaatataagaacttttccttatgtttttgcaatcttaatttttaagatttatcttgtttacccaatttcccaggctagaacctccaatatattgttaaatagaagtagtgagagtggacacacttatgctgtacttgagctttggggaaaagcattcagtctttcaccattaagtatgatatgagctgagattttgtattgtttgttttgtttttgtagatacccttcatcaagctgaagaagttttcctctattcctagtttattgaatagttttttttttatcataaatggattttggattttgttacatgctttttatgctctattgaaatgaccacgtgtttttttgttcttctttctattgatatggggcattatatcgactggttttttggatgttagaccagcattatatttctgagatatatcccactttgtcatagtgagtgtgtaatcctttttgtatgtatccatatttaatttgcttgtattttgttgagaacttttgtgtttatattcgtaatagatgtaggtctggttttcttgtgatatcttttgtttttgtgtccatataaccaacctcataaaatgagctaggaattgttttctattttttcaaagagtttttgaataattgtaataatcatttgaataaataatgattctttaaataattggtagaatgcactagtgaaattatctgggtctgggcttttcttctgggaagttttaaaattactcattcattagaggtttttttttttttaagattttctatttcctcttgagtcagttgcagtggtttatgtgtttttagaaatttgtccatttcatttatgtccatggcatacaatctttcataccattcccttataatatgttttatttctgtaaggttagtaataatattccctctttaattctcgattttaataatttgagtcttctctctttttttcttagtcaatcaagctgaaatttggtcaactgtgttggtttgaccaaggaatcaacttttggttattaagttttgatataacttttctaatctttattgcattaattagtgctctattttttatgtattactttcttatgcttactttaggtttcattttctcttatttttgcagtgtcttaaggtggaagtttgggtaattgatttgaggtctttcttcttttataatgtagatatttatggctatacattttcttctaaacattgctttaactgcatccaattcattttagtttggtgtgtttttgttttaatttatctcaaaggatttctgaatttcccatatgacttcttctttgaatcactggttttatttatgaatgtgttatttaatttccaaatatttatacatttttaaaattttattctattattaatttctgatttgattccaatgtcattggagaatatactttgcattattcaaaccttttaaatttactgaggcttgttttatggcctagcatatggactgtcctgaaaaaagctccatgtacacttgaaaagaagatgtatattctactgtttgtgggcggatggtctatagatgtttgttagttctagtttgttatagtgttgtttgtttataattatatatcctttataaccttcttcccattctatacattattgaaagtgagattttgtagtccctaactattattgttgaattgtctgtttcttccttcaattccataagtttttgctttatgtattttgggacactgttgttaggtatttatatgattataattattacctttttctcatagattggcccttttatcattattatgtgtcttccttatctccactaatattttctggtcttaaagttgattttgtctgatattagcataaccactctggctctctaaagttgctagtggcacgacatatcttttttcattcttttactttcaacttatcctctgtggacaatatatagctgaatcttgtttttttatccaatttaacaacttatgccttttgatttgactgtttaatccattcacattgcataattattactgtgattggatatatgtctgccattttactctttgctttctatatgtctcatatcacattttgttcctctgttccacctttattactttcttttgtattaaattaatgtttgaagtataatattttaatttttagtgatttttagtatatttttagctgttttcttagtggttgccctagggctgtgtagactgactaagaaaaaagagagaagactcaaattattaaaatcaagaattaaagagggaatatcatcactaattttacagaaataaaaattattataagggaatagtatgaacagtttatatattaacttatcagaatgatgtgtactaccttaatgcaagtaaaatatagacactttactcttacatagctctattctctcttcctcttttttaatattgttattatacatattacctatatatatgtaacgaacctaaaaatatattgttataattattactttatatagttttatgtcttttaaagaagctgagagaagaaaggagagaaatacgtatttgtagaatttctttcattaatcttcttatttatcctttctgagtctcttcatttatttcctgtgcattcaggttaccaacagttgtcagcttcctccaacacagctccactccctttcacctcctttgggctctttttgataaatatgttagattttatctttgttataagccctagattatattttgagtgaaaggtctacaccaagcttgtccaacctgcggcctggggaccacatgtagcccaggatggctttgaatgtggcccaacacaaattcataaactttcttaagacattgagggtttctttttttctcatgagctatttttagtgttagtgtattttatgtggcccaagacaattcttcttcttccaatgtggcctagggaagccaaaagattggacacccttgtgtccaattattctacacaatatagaaaaatgattacttactgcagccctgggttcctggccgactaaagagaaacacccaatagaaacaacttccttctagcaagaattaacaatggtaattaagagactttgtaactttgtgatctgttcaaaagactgcccaaggctaagcctaaaggaactttccaagttattaacgagagtttcacaactctggagccttttatgaacaggacagcaatgcactgaaactatcacaactgcttcaatgtctgatattcctatggttatagagaaccaacatgaatattgcagttagaattactagagagctctttttcttatataaacacttcaacaaatatgagtttatgcataaagacatcttttttcagaagctgaataatgagcaaatccttttttacaatgttttatatttttgaattttaaaatttgttcagcatcccgagtcagacaagtaagaatgaaatcaaacgcaaatctggcaacagagatgttttgtgactcatgagtaagccattcaggtacagacaatacctgtcaggcaggttgggtgtgttgctagatcactttctccatgctcaaacacagatatgatgtctcgacacccacataaggtatttcatgctaaaatcaagaaatactgggagttccactgagaccttaactttcaggaaaaataaaatcagtgtactcattgaagagtagctataatcactctttggacacagaaacgttgcactcttttttgaaggttctttcttgaagcagacgtttctttccatttctttttttgtcagaaaatcatttcacaaactgctttgagatttaactaaatttcttatttttttttttttaaagttgagctgggactgggcatggtggctcactcctgtgatcccagcactttgggaggccgaggttggtggatcaaatgaggtcaggagtttcagaccagcctggccaacatggtgaatcctcgtctctactaaacatacgaaaattagctgggcgtcgtggcacgcgcctgtaatcccagctactcaggaggctgagtcaggagaatggcttgaacctgggaggtggaggttgcagtgagccaaagtcgtgccactgcactccagcccaggcaacagagcaagacttcatctcaagcaaaaaaacaaacaaaaaaagttgagctggaatttgagcttatttattattccttgaaaatcaagtgtagataccctcgattgctaccatagggagtgccacagcaagagctcagtgagtataatttgtcctcctgtttttttctttgttttgattgcacatttactctatcaataatatgaatgtttcaaattttgtctttgaaatgtggactagcaaaattactaagatactgagtacttaaagttacttataaaataccgcttaaagatatcaacatctgttcatctgtaaagcactctagaagttgtttgcaatttttactgacaactaagtgaaatataaagataaaacatttggatctttgatgagcttcaattagaaatgtttttttccagaatatatcatttttctaatgataaatggtttagattgtgttaatatttctgttccacaattgtattatttccttttgcccatagactttttattcatgcatttcttcaaaaaataaatattatattgtttcatcccaatgcttatatggaggcccaggaggctctgcatcccaacccctctgttttctgtcttacctgccaggtcaggatgagaaatgccattgggcttattgaggcagggatggtgagtctagctttcagtttcctgtacctggctgacatgattttcttcaccgtcacttgctctggctggtatttgtatccatatagaaaaatataaacataacaaaagctttggacaaatgaaatcaaattctaattctattagaaggcacctgatgtcattctcttaatgactttttagagtattactgcacaaataccctccaccagggggtaggggaggaagcctgtattctcctctgtctgcatatctagtactttgctagtggctgacttggtgctccataaacatgccgtttcttcctgacactttcattttcttaagcccattaacagcatgagatagacacatatgggtggattcccaagtcagatgctttgttctgaaactatctttaaaatctactgtagactgattttcagaccattttccagtgatggaaacaggctctccctgtgaatttatgcagccttgtttcccctaacgtttcacccaaaatgaggttagccctggaaattccagtgtcccttagctacaggggccctccactgagaatggcttactcctatgtgtggtacaagtattatgtttgttgcctgttcacatcccaggaaaaatactgatttctgctcctgaagtcataaaagattattcaatcataagccttatgtttgggattatcttcaactataagcggctgcacacattcagcttgttcttcctgactgaagggtccagaagcagacagtctatgggtgggagggtaactcacaatgtcaccagggacccagttccttttcatttctactcagtcatccttggcacaggcgtggtactctgtgttacaagagggctgtttggtccaccagcagcaagaggaagggaaaggggcaatgggcaaagatgacatgtctattggcaaactcttctaaagagatttcccagaggcaggacgaacttctcacccaaaatttggttcagatgttgagactgatgataccatatatgaatccactaagaaagtatggaaaggtttattgcttacataatgatccaaaaatagctttagaatccagagaagagagactggcttggcgtttattgtgggtagagatgaggctggggtgaaggcttttgcacaggggtagaggcttgtggggtttaaatttcccaccaattccaaaggagggagcacctgggccttcttttcagcttcctggatatggaacaaaaggagaagagggagtaatgagatttgaatgcagccagacatcagaaatgtagtcagactctttattgcactgtctcaatacccttctcctggcatcttacagcaggctgagaaatgtggtgttttagtggccacaatggagggctgttagcacaggagtgcaggatggaggtgagcgggggggcaggcagcagactctgccagcccagccatctcgtctttcctgctgacctccattcaaagatgaaaagtgaccttggctgtccacaaggatcaatggtgttgaggtacctggctcacttttgttacataaccaagtccagtgaactacagtaatgtagccttttccaaagcttgaaggagcaagaggaaaaccatgagaaggaagaagagagctaccctttgggacacagcagggcccagtgagtgtgttcagctataaatatgggcatcctaaagatccatcgcaatggtatgtccttctgttaattgcaaagacaaagggaacacacaagctaaaaacaacaacaagaacaacagtaacaataacgatagaaagcaaaacagcctaattctgtcctctaggctggagactgtaattttttccccaccgtaggatactgttaagtttattctagggtgagtgggtgcccaagggaggcagtgagtatggctgaagtcacctggtggcagggtgctcagggatggccacaagttctacacggccctgcaggacctgagtctttagtcagttgggaagctctaccttctgccccagcccaagagggttggggcagtcacggatgtagcagttttcgtaattcacagggatccatgatgagcattgagcaggcttgattctcacacacatacgcagtggcctggtcttcctgccttcggagggtactcaggaaaggcagccagtgggacaggaaactcgaggggtccccatcagccagaatcagcaccatgttaggaatgtagacagggtggacgcactgcaccagaactttggtgtccttggcctggcggtctccacagatggtgatctgcctgagggtctgctgctgggctgagagggcacggaccatctccggcaatgccaccgggacatggtgcatgtgctgggagaaggcagtcactaggcacacacacttgtccatccagtccttgtgactcgtgaagctgtgcaaccagagcgggttgtgggctgacacggaattggcgctgggctctggagactgtaatgttttaaactctaggaggaatgtcctctgaaagattgttcagaagaggaagttgttttccccactggaaggaaaagaggggagaagagtcagaatgattagataaaagtgctttccaatatgttattgtccagagcgtggtgtagaaaaacaaaagtatagtaaaaaatgattctccctttcagttctctctttaacctttctctctctctcacatttttgtactcagatgttgctccctgcttaaaaataattctgcagttgaaaagcaagtcacttgggaagatctgcaagttaaagccctaccaatagttttcaaatatgacaataaatgtctgggtggtgatgaagggtgacttgcagaagcaccattttccattgagaaggtggttattggcttgctattagaggaggaagaaaagatctatgtttatggtgctgatggagaagcattcagaactagctgcttttgtgtttaatatttcagtgaggcaggtgtccctaaaggcatgttgacacttacctctaaggattcaaccagaaatctctttgatttgacatttattttacaactttgatgtttgtgaccactgctcagttcccacaggttgctgtttgaccacgacaaggtcacaaagccacgaagccataaaatatgttcaattcaatagctagttatggctctcggctcagggaccccacctccccaaaaactagcagtctagaggactcccttggcagagaatctgagcacatgcgttctgcgaagcctcttctggggtcctgatttatttttattttttcactttctcccctttattctcttgatgagcttcaaaaaaaaattccattgcagctggcaaggccgaaaaggtacttaatttcaaccacatttttggtaccctaggaaaactaattagaaataatatacagagaacaaggtatggcatagatgcacaagatctttgcaggccagtgagcaaaccaaagatacgagaaatcgtaggtctgccaaccttatcttaaagtaaaaaattgagttacaaacaaaatacaagtgccaccactcctagtgtggagaagtcagcttgggcccatatcccaactttaagtaaagtagaaaacatttattttatgtctgctttgccgtgactgccctacagtggaaacaggacatttttgccatgaatttatcatttgatgcagatgtttggctcaagtttcctgatcttgtcagcaaagttgacgttaaaacattagaacaagaattgtggtttatttacgttttcttacaaggtgtaaatttgcatatatgagctttgtttttattgcagcctcttagcctctagttttggagtgtatgccctattttttctccatgaatagtttgatagttgtacttaaatttatgggttctttctacctctttctacctttatttctccaagtaccagcacattttattacagtgattgctgctttcctgttatttttttaatggccatcaagaaatatagactcccatcgtagcattgcaggtggctaaccccatcttgacctctagacttttctaagtctgcaaagaataaaaacaaggaggaatttgcaaagttcatcaagtctagaccttccttagaggcctaatgattatatttgaagccactctggccagttttcctgattggaaatggttaaaaagtagctaggaagttctgaaaaagcaaaagtggttaagataacaagttaagcattagcaaggaagtttttcttcagttcaagtattaatacatggtctgggctttaggagtaattttacaccagttgtctgttttcctttcagaggtggatggaaagttgttctcaaaatgcatctgagttgttgaatatccattatgttacagggaagccattccttcttccaaaacagttttaatttttatggagtctaagttaaaacaggaacatttattttcttatgggtaaagttcctggaatgctctattacatggatttagtacattttttgaccaaataacacttgaccaaacattattttcaaaattgatctctctttaaaaaacaaaaagatttaaaaatatggttccttttgctgatgagcatcatactttggcatttagtctgtaaaaccttggcatttagtctgtcttcctggagctcagtttcttgaaatgcacatctcgcattcagggctttcatactcaacaggtggtaccagccactggtgttctgcttataataaaaatgatacatgtgtattaatattgctcttgaagttaataaacacacccaaatctggttaatttgttcaaattattgacagattctctgtgatttaccaggattaatgagtatgcaaatacaaggaagaatgcccaggatagagaacatcatggaacatattgtactttattgtaaaataaaaatagccctggacagcccatggaatgcgttctaacagcataatcagttctttactgtggttttcctgccaggcggggagccctgtgtcacacagggtgggtgccaagtgtctggtttgcgctttggtaagatttttctttttcttcctgataattttcaggtttgcagtttctccaagtgcaaaacatccaagccaccctccctctgcagtggagtattgattttgttctagatttctcagcaaaggttgggatattagagttcaaaacacaagtgggcagggtgagcccacagtctctgtgacggggcctgctggacactcccagtctgccggcgaatggcagaggcctgggacagcacggtggaattttcatctcgtgcaaatgaacttggcctcttagatccaggtcctctgctaccaacagtgaatttgttacagtgtgaaatgctgaggcaactacctaaataaatctgggcaaaatatactatcgaagcaatctgggatttccacccttcatgaattatctcacattttagtctaaattgtttaagaatgacttgctcacggctgggcatggaggctcatgcctgtaatcatagcactttgggaggccaaggagggcggattgcttgagctcaggagtttgagaccagtctgggcaacatggtgaaaccccgtctctactaaaatacaaaaaaaattagctggacattgtgatgggcacctgtaatcccagctacttggaagactgaggcaggagaatcgcttgaaccagggaggtggaagttgcagtgagccaagattatgccactgcccttcagcctgggtgacagagcaagactccatctaaaaaaaaaaaaaaaaaaaaaatggctttctcccttgctccctttttgccctctgtccacatggtcccagagtcggtgtttgaaaagcggctttccactgtccagagaggattattcttaacaggctgatgatcctggagcccacggccacacttctgggctctagtcacctctaatccacgttgtgataattggtcattttgttttgtgcaggcaagacttggatgtgcaattttcataccatctcttgattgtttacccaaacagaaaatgtaaccagggaaccagcaatatggtagttatgcacttcccaaatcaacttgaagttgatcctaaatgcacgctgtttccactgctgcttctctgatgcaggttctgccccagtgatagtgagctggggttactgtgaaccaagattgcacacggggctatatgtggaaactccgaccccatggtgcctgccacacactcacacacatactctttgagacccaaccaaaccagcactcagaggcaaagagtttaaagaggtggggctttatccaacattggaaccattttaaattccccaagtagctccatttcaagttcttcagatggcctatgaagatcgataggacgtctttccctaagcccttgccctcgtgcctctcctgacacacgcccagcatctctcttctggaggccttccctgctaaagctctttctgtgcaacttcttggctgactcctccatccccaggaggctctatctaacagcagcctcatcagggacaccttcccctcctgccacctgctctgtgttcccccagcccacatcttcattacacaaactatttgtatgctcacttataagcttaagggaaagagacagtaagctcgtctgggtaggaagtctgttttgtttactgcagtctccatatcctatggaagggtgccgggcccactgtagatgctaaattaaaacctggtaaatgttgaacaaataaaatgattaaatcaaatggtgtagtatgcaaggaagaaacaaagatagggattcaagccctgcctctctacctggctgtgtgacttcagctcagttattgaacttctcttgcttttaatcttcttatcattataattactgagatttgggccacgtttttagaaagttaagattttgtgtggctttttgagctttgacactttaaaattgtttatcttcttttctgattttttttttcctgctgggctgtaattttcttaagggcaggattattaaagatgcatctgtttatttcctgaaattcacaggacaacacttacactcaggtgctcaataatcatttgttggaaataacctgttttgttttttccccagaaagcctgtttcaaaaggtgtattttatagtatttgatctgctagatcgagggttggcaaactttttctgaaagaagtccaggcagtaaatattttgagtttcgcggccatactttttgagatggagtatcacccaggctggaatgcagtggcgtgatctcggctcactgcaacccccacctcccaggttcaagctattctcctgcctcagcctcccaagtagctgggattacaggagcctgccaccatgccctgctaatttttgtatttttagtaaagacggggttttgtcatgttggccaggctggtctcgagctcctgacctcaggtgatctgcccgcctcggccttccaaagtgctgggattataggcgtgagccaccatgcccagcctatatttctttatcacaactctgcaactctgccattttagcctgaaaacagccataaacaatttgtgaacaaatgggcatggctgtcttgaaatgaaactttatttgcaaaaaacaaatgacaggctgcatttgacctgggagctatagtttgctggcccagcactagacggttattgtcataaaataaccattttctaaaaacgaactctttgtttccactgtgtttctgagtaagttacatgagatcatttaagtttcatttctattgttggccatttgttatatgaataaagatttgctaagtgaccctcaagcttgggtctttatttcatttttagattatataaggcttgacccacttaagaaatgtaaccgtctttttatttctcctattaattttttttttgtctttgtgactatcttgtttatacaaactgaacctgagacaaagccgctagtgactgctttttgtggttaaactggtttcgaacccaccaaagtctagaagagggaaagaaagaattgtaccagatttgatgtgttttgtgtaacgtaagccagattgtacctccttctctctctcccaggtctgtatacaacttaggaccaagaggtggactttggtgtcttagttcaagctctaaaaataccagggaagcagggaccacgacacatcccaggcttggtgcagaaacctgacctgaattggaccttaagatcagaatatagatctattgtctttcctcacctggctgttaccaaactaacttccgcatctcctgggagtgctttctatttcatccaggcagtgcccttatctgatctggagtgggtttatctctgggagagctattgaagtgcctgacaggagaggacactaagagtacctccagtctccaactgcctcctccggcagaactgagcaagtcctaaccatgccaaaaacatcattatctctggttccatcttagtccctgcacaccctaggattcaaggactcaagtaagttggggaggggaacatcttttcacccctggaaaaccttgtctcctcccaagccctgggaggggagaactgctgctaatgagatgctggtagttagtcttgtaatttttacagtattatctgcagaatgaatgactaccagcaggtactctgaatctcttttctttctaataagatgtaatcaacgaaccagattgtggccttggagctgaccaaaggatcagctaaaggaattggacacatcctgagctagttaacacatgggtattgtcggtctaagatgctctttaggggctagtgactcattcatgatgtgcaggaaatggcacagacacctccatgaccacagaaggtttctacaggcgccgtcatcacagggtctacaaacagaaggaagtcagagagagaggctcaggggaaggcaaggcggggctggagacctggattctacgtcggagtttaccgcatcctggttctattcccaaagtcctctctgtgtggccatatgcctgattctcagcctggcttcattccagtcatctcaggatcttacaaacaacattgatgtccaggccccaccccagaccaatgaaatcagaatctcttggacattaaaaaaaaaaatgagtgattctttctgggtgattctaatatgtggtcagggttgaggccactgctttacttcattacatcatgacactaaaaatactactggaaagaaaaaaggagggctaccatctgccttccaatctcttcagctgggaacctcttcataagactgtatctgaaaccaggatacgagatccttataagtaattccatttataataacaaagaaagaaaagaaagaaagaaagagagagagagaaagaaagaaaggagggaaggaaggagagaggaaggaagggaagggaaagagagacagagaaaggaaagaagaaagaaagaaggaaagggaagaaagaaagaaggaaaggaaagaaagaaagagagagaaagagaaaggaaggaaggagaaagagaatgaaaggtgtttacagctggaaatcaaacagaactttgcctgacacatgttcatttttggccatttttgccttttttgtggtgtgaaccattagttcagcccagttaaccctgagaccacccacaaagactgaattcagaggtggctgtccagtacagtgattcaaggtgaggcctgtgaagtgagatcaagatttgaatttctgcttctcagttcaccaactatttgaccttgggcaagtgacttaattcaagacttagttttatcatttataaagtaagaagaataatacctgtcttacatactctgatttgttgatatgatagtcaatatgctataagaataaattaataattaaatgacacggtagacataaggcatttaaatctaattcctgatccacagcaaaccttcaacaaatagcagctgttatcatcagagctaaaacgaatcatgtatctaggctagggtctggtttctttgctgttttggataatggcttaggaataagaataatgcccactgaagaagtcttgatttttcttaaagctctaagctcactagagttttttgcgtgttgccaatttcaatcagatccaggagtattggttactgttggcctatatgatgaagattaacttttggaagaatctttctgtggaatgcaggccaaaagaattctgaggctgcttttgatttgctttgagttcgttgcagctaatgtgaaggatgcaaatatttctatattccctactatctgcttggggtcttcaagagatgagttacagtgacctggaggtaacattttaaaaatgctagttaagattagtgttaaaaacacagacaaagtctgaatctctccaatgcttgattttaatttttaaaaaagaggaacatattacaaaggaagcagaatttcaacataatctttagatggtaaattatgttttacattagtctgcattattaccacaatacttgcacctggctggtatgaggagtgtgtgtgtgggttaaagggagctgttatttacctgcttatctatcagactggtaataccaatctcactctgcaaatttaacatcagggatttactgttcataatagaataaatgcatattgagaaccacacttgaacttagcccttctgacaggaaactttcaaagttagaagttacactgagcttgaattttaagagagaggaaaagtcatttaataaaactaaaaaatgaaggatggatggatggatggatgcataggtagatggatggatgcataagtggatggatggatggatgggtgaatggatggatggatggatggatggatggatggatggatggatgcatggatggatggatggatggatggatgcatggatggatggatggatggatgcatggatgtataggtatatggatggatggacagatggatggatggatgcataggtagatggatggatggataaatggattgatggatggatggatggatggatggataaatggatgtatggctaaatggatagatggatagatgcataggtggatggatggatcgatgggtaaatggatggatggatagatgcataggtggatggatggatggatggatggatggatgaatggatgtatggataaacggatggatagatggataaatggatggttggatagatgcataggtggatggatgtatggatgaatggatgtatggataaacggatggatagatggataaatggatggttggatagatgcataggtggatggatggatggatggatggatggatggatggatggatggatggaaagatgcatgcatgcataggtagataaatggatgaatggatatgtaggtagatggatggattgattgaataaaatgctgaagttaatagaatcctctgttactctgtatgcccatatgttcttcatggccacatgtaaggttagccttatgatgaaagattggcatcagtattgtcatttttatttcagcttgtgcctaggttacatgttctcatatgttccccataaacattcacatggtccagtgtgcaactatgaaagaagcttcccatcacctgtgcctcccaatctcaccccactcactgcaatctgaggaagaaatccaacaccaaacaaacactagaaagcaccttgctggcgtgggcttcctgttaactaaactaaaattccatctctaggactcagtgaactgacaagtgttattgcttccaaacttgggctatgttcactccatccaggtgcatttctacaattcaagtaaacattttcactgtaaacttattgctagtaagagcacaccacatcacaaggaacagcaaatagcagacatatctttgcgccttcacacagcagcacagaaattatatctggtacttgattcagtgtcaggtggtataagcacttcatcaacaaatgaagaacagaaggggtaactgagcagcgacaaatatttcgttaagttctgtaaccaagataagagatagattctcacacttgattgctgggaatacacacatcctataaaagccaagaaagttagaaagttaactaagtggcacaaactttatagcttatcagtacaatgcaaggcacttcaggaaaactggcatgataaagcttggtttcctaggaacaagctaattaaattatatttattcaagtaatctaaactatttaactattcaagtggttggacaataaaagaactagaataagactcagaaaagcctagtacctacattgctctccctgggaggtgcagcagcactttgagggcatgcaaattgtttaagatattttaaggcagctcaggatctctgcatacattctagtgaaaacagcagatcttgaaggaactggagtgcacggcttctgtgtcccacaattcaaacatgagaggagatgagaactcctgtattataagatggctttgcacatgattgttcctagaggtgagttttcaggcaaaacagagggagctccctgtctgagtgcaaccagcaggaagaggaccttgatgctggccacctttgcccctcaccatggagctgcattccctgatgtcttctgacagaacacacgtggtgcaggacaattcccatgccttcccttctccaaactgcataaggaccctgggaggtaaactgtttttctcagttcactagtgcaaaaccatctcagataagtcaatccgcttgcctcagatcattgagttagtaagtagcagctctagaatttgaatctatagctaagaccaaacctacatttctcccttgcacccccaatggactttactccttgccagaaagaaagaatataaccatttagtgtcccaaggcaagaattacagcttcggttcaattttgctgttggtgtccacactgtaaaatgagatttgactggcaagataagacataccactgagcaatttgaaaaacaaaacataatgacttttgcccaagagattgcaatgattgtttaaattgataacccaagtactttttctgatgtgcgtactaggtgatatatgttatttactgattgataaatggtaaggctgcacctttagaattactgctgcctactaagtacacacagatttcagaagggaagtaagcagaggtgagttttcagtcataactcaactatcactctgagttagggtgaccacaatggcaaaccaaagccagtggaacagaatggatgacagataggaaatattctccagcatgtgatcaggaataaatgcatggaggtgaaacaactccaggaatttttcttaatgaagaagtaaagaaaacacagtcactgcatgtctagtctgtataggtgtggtcaaacaccaaggaaactaaagactgtatgtttgactttaatttcagaagcctgactttggctcagtcataattctctagcttttattcttcaggtcagacagtcaaggagaagaaaaataagaaaaaccagtaccctattattaggcattctttatcatctctttttcagctggagtctccatcatctctacgtgcacatttgataagctgaagtgcaatgatagaataagatgatcttggacagctttctctttgaattcatttttagcttaatgtatttgttgtggcttctctaggaaatgtttgctgaattagcccctgtgcattgctagggctgataaggaatagtcaagagtttgagttcacaacaccctctttctatactcctgctagtccttcagtgtgaagtcccttagatttttatgacaactgggctgagatctttcactttacgtaacttagccaattcgcattgctcagtttttccacaataactagaatatttggcaaaagggcacaattttgcaatgggaaagctcccaaagtgaaaaacctagttgtttacccagttctgctaataataaatacccaagatgagacctgggacttctcctaggccctcttgcattgatgccaggtagaaggaggggtattagtgcagaatcagggtttgaatgacattcttctctgtggatattagagggataaactgtatggattgatagggaggtggttcagtatgttacaaatgaggacgttatagcctaataatatcactacatgctggagcaaataaagggccataaaacatgcagtgtgtacccagctagctcttccagaggccaagaactaaacttggaaaagggtgaaaggggcctgatctatgctcaggaattgaaatgtcatagcaagaaatatcagtacagaagagatctggaggttcacatgcttcagacagtttgatggaacttggtgatgaaggacgtgccggaatacagcaggtagaatcaaacacctggcctgtccattgatattgccaacttgaaagacagatatcccattggcttggtgatttgtttttaaagctgaaatgtgtgattgatcatcagtcaagcaccaattgaccaattgctaaaatatgaaaatggaaggaaatgtagaatgaatcactacttttgtcttctccagttgatctttgaaattattcagggtgataatcgcattttctgtaatattctatttcaaatattgtaaagtgggtcttggagtgttgggttcaaagtcagtctgttgtaggtaagacgtgtctggccatctggtagagatagggtccacggcacacatacctcacagtctggcctaggagcctccctgtacagttgattcagagttaaaccacaataagacaacaatagaagaggtggggggtaatacaagccagcatgccacacattgatgaatgatccggcgaggctttcaaagcaaggcgggattactctggttgcagtgggctggagaaggtaactgtacttagcagatattgcttttctatttgccagcccacactgtcaacagtggaaaacagtcattatcatatcccttctttgacgggaattgccacaaaatagttcacttggtaaaagcctgtctgaggtgaaccaggaacaaacggtgtgtatttaacatgtggtgtaaggttgcaccaacaataaaggaataaagttcaatttgaataaggcaagaggaaaccggatcaccgttgggttcatgtcagtggttgtttcacagtttctcaattctgaagccatgctgctgatagggacctagaatcaccaactaactccagtagaagtttaaaggacacttccatacggagcccctatagagagaggcgggcacttcatgcacccaacttttaagtatatacattcccacctgacaaagttagattttacagatgccgtggcaaatgtgcactcagtgctaacaaattaggatatcaggcctgtattaatgctttcattttccaattattttttattgcatttaacagctgacttcaaaagagctgaggacacacagaggaatagcgtgacccatcatcgcaatttgccagcgagtaggggatttcttaggatgtgggactttaagtgttaaaaaccagggcagtcagtggaaaatcaggattattggtcaccttacaaaggaatgacttggaggtaacatttttattaagtaagttttgcatttttggataatttttgaaccatctcatttaagaagaatgtggataaaatagcttccatgtcttcctgaggaggaacgctttgtgttgaggatggtgggtggtgggaagatggggaagcctccagtgggaggctagaggttgctttcagctccatttacttctcccaagggaaagctaaaggacaaggggagacaggcgattctataaccaaagccatttttcttgtgatttcttgctgtctaaactccatgaggctaaggctagagttacattgctaaactgtcccagagatcagatcacttggctcttttaatctttacttaaataatctttaattatttgctcttcatttttcctggaatgtcaacaaccctactttgtctccacctatggaaatcttgtgggctgcactcaattgttcccacctctggaaggctaccttcaaactcccaggtagagtaaattccccttcctgtgggcttctagaatattatggtcctataacacttatcacacaatatcatggttagctatttgtccatctttctgctgaactataatttactccagtttaggaactggagggtctttggaactcagcaaaaagaagacatctgatttagttactaatcaaactaaattgacatgataccaataacaaaggtttctattagtaacaagaaagccctgctaggattctcctggcattttgaggaaaagactatatgcataataaaatctcgtgcatcttaaatggaattccacattttagtgctgaaattcacgattttattttaattgggaaactgacaaagtggaggaggatgggaatattgagggattgaggagcaatgattaggggtagtaatagcacctgcaccatggattgcaaagcattctatcactcacaggattaaccatcatagccagtgctgctgggagtcttccccaagccctgtgaatgttctgcactgcttctgagagcccattcctgtgcttctctgtgtgtattaattttaacagcctgctgcccctaccaccatcttcataagattgcccttgggctatgggagccacttccatttccattgcagatgcaggaagccagagcccttgggaaattgcatgctcccatcaccctttctactctcagtcaaagactgatgggcagcatcatgaaagcccagctctcttacctaggatgctattttcactccagaactccctccccaggattaggcagggactgggtcttgtccttgtcctaaaattgtaccctggcttcttcccttcctgacttgctttccccacaccactttgggttcctcctgggagtactactttaataaattgcctgcgcatttttgtctcaacgtctatttccatataatctacctccagacaagattttaattttgtggcttcccaggacaagcttcttgctagaaagacccaaaggcaagtaggtcctcacctctggcctgtgaggtctggaaatgggtacacattatgctccaagactcacctatattccaaggaatcattttcaatgcctctaggataaggatggtgagaacaaactggagacagctggccatatcatgatgcacctgtggagggctctttaagctgctagattcatggaagattctgaggaagttttaagaactgttgtaagcttccataaatagctccatatctaacccaacttaaatagaatttattccaaggtaaaaatattttttccctctcatcacactttaaggttttttatgtcttgattcaagccaagatgaggattggaaacattatagcatttttttttcttttttggaaattattcttgggaaacagttctcttgaaaaatttggttcttgtgaactcttctgcccagtattcagatgtcatttcagatcttcatagaaaaatccagacttctatgtattttctatgcaaatttgacacaactaagagtctttccgttaactgtggaggtgggggttggggagcagaaagaagtaaacacaacttactgaatagtcatttatatttgtttttatcttcggctaaaaggtcagtaaaattaaccatgttcaattatgaaatgattagctatgttatttcatgtaatcttatacactagatttcccactttactccttagaaccagaattgtgaaacaaattttactcattggatgagagagagattgcatggcagaaaatattattttgtcaggattaacagtttgtcctatttcccttagttagtttcagaaatttccagaaatacttagatcattcagttgttaaagcatgcttaacaaagcctggcctctatgacagaagtcacatagacgcgcattttagaatttccccactcacctctcaaccctgcagtcatacatttataatgtctcatctcctttggtaaactgtcagatctgcagcctcaaaatctaattgttgacatatcaccaaatgaaaagtaacaaaaacaggtaaacatcaccaaaatgaagaacattgtcttagcatttaaactttaaaatgtatttctactactctggactcattttttccttccatcatctttaaaattgttataaatgagtatctgctccactgtgtatggtcctgcaagaactaaaacttcccagagtattaaactgtggttaaaattcatgcagtatgtaactcgatgctgagaagaagctacatatgcatatgtatgctcaaaatataagaatttaagaaaaatgtacgataatgaaaaatgcatggattgaaagtgaaaagagctgttttgagcttcaattcatcgctctgtagctgtgtgactttgcacaaatcacttatcttctttggcttccatctccttgcccttaaaatacaactaatcatgcctacattttgatctgagcatggacttaacaacatttctggcagtgttttacaaattgaaaaaaaggtgttcaaatgttagtttattaagtaaagcttaggctggaaatacagattaaatataaggagataattaaagttccacggtaacaaatcatgtcttccatatgtaatcttttgtcaacccacttgacaaatatgcatattttttgagggactatgatgtgccagatattgctggaaagatgtttggtgaataagacaggtaccattgagctctagactggaacacagatggtaaatggaaaagcttgagggcaacttcagacagtgataagtgagatacacaacaaaaggagtcttggggcacggacttggatcaggaccagatcagataaggacctcccagaggaggtgccattcaggctaggacctgaacaatgagtcagctcagtgaatgaaggccagaggggaccattccaggccgaggaaacagcccctgcaaatcatcccacctgagcagctggtatatactcagatcctttaattctcagttttccctctttcatcgttctgcacctctgtgcttacctgttttctatgggacttttagcatatcctcgcgggaggtctatctgattctagactccgggagtaccagctctaagaagtccaaatctcgtgtagcttcttcatcctcctgccctgaacccctgggagcccagtgtcttctttccagggccaccatttatactcccaggctgaaaaggagtcccttgcttccagggaaagaaagagcaaaagagaaggagactgaggcataccatctccactgggaaaacagaaatggaatgatttatgccctgagctttgagtcagcagggagaggggggagaaaataaggaagtctcagcccttccttcctaaagacagaatgacaccccatcccttccagctcccacttagttcaagcacccagaacagcagcagctgcacttggggtgaattgcagagcccagtactctggggagaggaagtatcattcatttccaacagaagcaaagtgttcctcaccctgtctgctctatgtcaaaccagatgccgtggtctggccccaccgacatgcctgggcaggggacgtgtgggtatatcatcgtctcccatgggaaacagaccgtttgcgtctcttggcattgcctttggaccagtgtagagggctctctctaggggaagtgcttttgaaaaacccattccatctcttaggattgaccacgatccccatgcagtctggccgtgagaaggccaggagagcacatgagccttggacgggcctcccttgatgtggtggctgcaagagtcactttgcataggatggacatataaccccattcccgaaagaagcttactgcctctgcttccagagatcttccattagaagccttcttcaaggatggaattctgaccatttctcataaagatgccagactatgcaagaatgctggaactcagattccaacatgtatcccgaagcccaatttccatgatccagaagaaccaaattttgcccatgtctattcagcttatatatatatatatatataatatttatcagggaaagcagggcaatagaaaaaaatcagctcaataaaggggttgagctaaaaacatgagttttcctctgtggcattttgcttaggtatgtttgacataggtatagtctgtatggattcattctgattccaccaggaggcaagagattttgttaatattcatttggggaggagagaggaaagagaaaaagaaaacatgggataaaggagagattgttagaaaaggtaatctggttatttatttatagtttacttagccaaagggaccttaaaatgctttgataagaatggccaaagtttcttcaaagattaactggcattctttaaaaaggcatcagttttcttttgcacaggtgtttggagagcccggactggatgcccactagaatcctgtgctggtttgtagatttccttaagaccttaagacatgctgacatcatggtctcctttctcagattccttctctctttttctctttctcccccactctctctctctgtctctcactttctctcctttcctccctccctccctccctccctccttccctatccctccctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggtaagaggtacacggcgcttatgttaactctggggcatgtggcacgctggaggtatttttgaaaaactttacttctaaaggtaatgaaagcgttgtgattcttttaaagcttatttaaatcatttaagacgcccgtgcttatctgggggaatttacaagtgctgtttgcatgtggaaaacgggattttacttaatgatgggacaaaaaaaagtgttttattcttgctcgtgaaacaatatccagatgtcgtcttgtttgcggtgggtgtacgggggtctagcttgcgggacaagaattactccgacttctctttgcaagggtctgtcagagcaagtttgttgattttcagcgattacatagttctttggctaattctgaagcagttactttcctttgtcaatggggaaatcagtttagattgccgtaaggcgaaacctcgccggaatattttaaaatctgttacctatccttttgagaaaagttatgtaagttttctgtggtaggtgtaaggaatgtaaacgatcctgagtttggaaatattatgaactttgttcatgacccatgattaatatgttttttaatctgtgtataatttcatgagagtttagactatcctcagctaataaatgttatactgggtgaaatttccacattgctcctgtaacgccaacgtttgtctcctctgtacttccgcatttagtcacttgaaggaaataagaatttattgttcaatagacatttcttgacctcataatttcttttaacccacaggttagaaaacttacaacgaatgtagtatttgactgtggaaaactaaagaccaaaaatgtgtaccattaattcaaatgtttagatttatctttttcccctttacctgtaagagggattttgaaaaaaaaaaaatccaagtgattcttaaaattcattttttgcaacctcaagatcacaagcacacactcacactcatgcacaatcaactgttatccccaatcctatcttcttttgtcctcttgtgaatgtttaaacaaatatgaaacaatcggtagtaatagccttaggtgacaaattctctcctatttaaaattgtcctaaaaatcaaaagaaaagtgtcccataaagctataatacatttttaaatatcatcattttgtgaaaactaaatacagtatcagagacacttccagccgattaattaggtaagtaagcacttacctcacacacagcttccccgggcgctgttctttcttcccataccttctagggttttactttttagcagtttttctccttctctgttaatataataagtgaccatccagggaatggcccagaggccacaaggcaagtcttcccaaaatactgaagattagaagagtttaaccaaattcctggtagcagcatgtcagaaacgctcatcaaataacggaacagacctttcttcactgaattaaataaatgtataaatagtctgggggttttacagaaattgccttagttgaactttgtgattctggttgcttaaggaaaacacatttttctaaaacgtcctctctccatgtttccactccttcctcccaccaacagttgtggtcattttacagaaagtcttatttccccaatttcctctcctcacacttctcaccagtgcagacagccagtgttttggggggaaagagagcgagaccccaggctgcacatgccagcaaacctgagaagccaacaaaagcaggtctctgggctctttcccataaggctcagcacaacctcactctgcttctgcatcgaggaaatctcgaaagggctgtgctttcttggggcgtgtgtgtgtgtgtgtgtgcgcgtgtgtgtggtgtgtgcaattatatacctgaataacaatgacatactcgttataagaaaactcaccaatatgtggctttaggcacggaatagagaggcaaagttattcggatttaatcagtacatgtcaaatctttggaatatcctttcctgtgcaatcccctctcatctgtttagagactcaaagcagcccacgaagttttttgcatactttgcctcagagtccaggattgcttatgaaatgtatttgtgtggtggatgcgtcagagtcttagagccaacataagagtccagagactgagctgtaagcatgataaagctgtcaatgactggcccgtgggaatgcttgttgaaggcatatacacctccctaatcattttcttcagtctttaatatgtaagtgatacagctaccgttatttttttccctgcagcaattcaagcattgcaccccggattaaatcatgtatctctaaatatgttgttttaattctttcaagtaaaaataattccacaccgaaaattgtcagaaagccattacatgagttaatattaacttttatgtctgcaaagatgagtttgttgcttattcatgggcaaatacaagaggcaagtcagacagaggttattgtctaccttctctctcttctgtcctttacctttatctcataaaagccacctcaggagtggggcttttggtgcagctgatggtgggataaggccggggaagtctggatctagaacaaagtgaaccaagggtgagccttattctatgcccctcaaggatgcagtgccctggaaggagacaggtctgactgaacacacctggctcaggtaacttcctggtgccagttttgcagacaggtgaaggagcagtgtgacccggtagtagctccagagacaagcaatctaagaagtgctaaatcttccctaaaagaacacaaggagcctgctcctacctttaaaaggagaactaagggcagagagggagagaaactaagttataatttataaataaaggtttataaacatttaggaaatgcaacttctttcttggatcctttatttataagttctgacttagtttctctccctctatgcccgtgattctccatttaagaagttttatttgctaaatattactctgttgaaatgaaagaaaaaaatgagggggtagatatttctgataaaaaggccaggcgagaaagttgaacttgacaggtgtagcctctggaacacgtctctggatgaattcagatgatagtagggggatctccactcatcgtaatgcagctggaatacacatagtgaattctgtcacatgcccagggagaatttcagtcagaaacatctgtgctgttttcacaagggaaaggtcagaactccatgagtagttcatgtgtctgcatttcttttgatgggcattgtgcctcaactagagaagagatcaataagccaatagccgccactatccaatttgaatccagaagttcacacaacctaattccagaatacagtttgtgcttctagatgaaaaattctaaagcacaagcacacaattccagatattttagccactatacaaagatgaatcagggtcacgtgatcatgctcacgtcagaagatgcaggagaaggacaaagttttgcattttggtacaaaacacgcatgtgccagccacccgattcgtttccagtagggagcagttgagtggaaggtcatgtctgcactaccttaggactgaggacctacagagggaacactggaaagaattagcaacagaataagccaggttctgtttgattctgtctctcccaccctgcagctccaattcagagcagtcttaatgtgcagggatccgcatagaaccagccaagcagggcctctcgtagtagcctgaccagaagtcacagaggctgtgtaggccactcattccctcattcagagttcagacatcctgagcctgcccatgtccctgagattacagataacacgaatcctcagagtcaccgctgggccatcaaagaaaaaagagggtgacgcagagagggaacactgcaggggaggaatgcaattcttagggtgctctgaggacccaggtgcctgggtttgggtttcattcacatcctgcttcagtcggagctgccctggtgttgggcggatggctatggaactcatgtgcattttctttagtgtctacactggaggctgatgaagattttatggacccttaagattgcacaatttgggggctttctttagagaaaacaaatgcaaaattaggactgtactattaagtacaaggatttggataggacctgggcaagtgaggaaccctgaagctgaagtttcattaacttcttgataaatccactctgtgtcatacatagtaaagccctgatacttgtctcttgaatgaatggttgaattaacttatgtaaattttagctgctggctgctctctcaataactctgaaaaatgataagcaaaaaatacctatcatgtttatccatatctagtgatcagtgatatatggaaaaccaatcttaatgctatctagaatgtttcttgtttcattggcaccttgccatgaaaggtaggtccttgtactgtagttgaacctttaggtcatatctcagctcaagggtaagatgctatcaaagctgcttttcctatggtagaatatgtgagtactgaaattaactgtgcgctttttccacctgaaaagcccccaacttaaaacctaaagaacgttatgctagttgtgccactagaccctagaatggtattgaatgcatgaataataagcatcttcctgagcagacttgagggcttgccccagtggaatatctgtgtctttggtgagaagccttcctcttttttccttagtttctattaacgctgtttccaattttcaatagcagttaattgtgtcatttcttggtagaaatgctggctaaacccatgcctaccaagccaaataatgttctcactcaatgatgtttacattttcaaatatttgcagattgatatcttgcttcatcttagacctctttgccaaaaaatacaaggtcagctccctgaatcttgctttcttatttcctgagttatccttcatgtctattccaacctttaaaggacaaatttgaaaagtttatcctctgctttgaaagtttatgaaatttgtcatcatttgtactcttcctaccaacgccattctcacatatctgctaggaggtaaagaaaatataatgaatcctggagcacctggctgctgtgactagcatgctctaaatactaagaaataagaaacctgccctgtcttttttatattgtcagaagtttgtggaaagaatttatatatggacagtgagctgtattacatacagacacaaacatacaagtgacaaaagcagtgtgggtgtgtatttagctaggacattaataacaaaactgactgtgtaggtatagagaggctatcccaatgtcaacaacatcagaatacaatggtactgtattttgaacgtcttgtttaatatatttcaaatctataattttgacttacagtcaaaattaaacattaagtgcacacaaaacaattaccctttaaacagtatttttaaaaagtgatgtcatagtgacattgacatctgacatctttttttttttttgagatggagtcttggtctgtcacccaggctggggtgcagtgatgtgatcttggttcactgcaacctccacctcccgggttcaaagattctcctgccttagtctcccaaatagctggaattacaggcacctgccaccacacctgcctaatttttgtattttcagtagagatggggtttcaccatgttggccaggctggtcttgaactcgtgacctcaggtgatcctcccacctcaacctcccaaagtgctgggattacaggcctgagctaccgtgcctggccgacattgatatcttaacgtcactccttaaaacgagttggatataatgtcaaacgacttgattcttgtcaacaggaatgctgtgataatctgattacggaagactcagggtcttggttcctaggccctagggacagaagaaggctagcttctcccagacaggccaaagctgctttgaggagggaaggggaggtgaagtctccactccattgccagcaggacacacctgcctaggaactgggggagaactctcagaggctgaccctatacttcctgtctctggagtcaggggacaggggtgattctgctggtcagaaggcaggagggagtgtcctgaaacacaattgaatttgacagcaaagcactgtctatcctgggaagttctgctggtgagcggagtcctgtgagggtcctggtaaccctatccctgcaagaaataagaaggtctgcactcaaataggttcagaaaacctttcctagtttaggcccctcttgaatcttcacagcaatcattaacattttaaaaaccccaagaagttctgcagcaaagacgttctttaactttgaatccaagttgtacatccattttggaccgcagaactgtccaccacctcctccctgaccacaactatgattccctcctctgactaacgtttcacacaaccccacgggggatgctttggccaactgtgatgggtgtggagtggcaaggcatcgtgcgatccaaagaacatgtgtgatgtccaggctccatttaggtgtaagttgtactactggggcctgactacctctgcatgtgactggccagccttcgggattgcgaagtggctgcttacagtcagccccaaagaatttttttttactttctttctgtttctttatgtccaccttattcctaaaagaatttaagtgaatttacaaagatacatacacacacacacacacaccatgaaataaaagaggaggaaaataagagtaaatgtcaaaaaggccatttgattaaatcatttacttacataaatttgaactatttttaaaaatcacagttgagtgcacacagatccacagtgccagaatcttacttttgagctcaacattaaatatagatcttaactacatctgaacttaacttagcttcctatttgaacctgggaatcaactgggcactcactgaatgtagttttacacgcactgtattttacaattcttttgaaagacaatgtccattttcctctgtggatcttttaaattttatttcaccttttacacccctttatgtataatttgtttatactgagattgtaaactttcttcattggcttagactcaggtctggcactagcctaagggactaatctctggtccatcaggcctgggctgggaaccctctgtgggattccctccccattcccggagatagctggttcgccctgcttggccccactttacaatggcctgcttacttgtcccttttccctacagggctgcaaactctttgacaatggagattttatgtagttatttctttgtgctttcagggcatggcccaaggtattcttcaagcaatatgtattgaatccacaggcactgacatgaaaggcataatttttgctataattacatctttactttcaccatgaacttacatctacctcatcctgcaaacgcacagcagagacctttttatctgaagtcttttgaaaatatgtgtatgtgaaaatggctaactggtgtgttctctcccttggtgaatattacaaagtgatagattggctgctagaattgcgtaagtggggttattaaggagggagacatcttattaaggagtgacaagaaacagggaaccatgtgcttaagatatagaagttgtgtaaacccaacagaggagaaatagaaaacatgcaggttattttggaaagaagaaaatgaagacacttgaaataaaacagaaaagtaaatacggagccagcagggttcagcatgggagtgtgggctggaagtctgattctgaggaagaaaacaaggggaaaaaataaaagaaagaatatactgcaatcccaggctagaaaggggtgatttgatccatggagcagcaaatgcagaaaacaacaaaattagcatcatttcagtctccttcaaacgctatgtctagatctggcttgtgttagcatacctgtggcaataaaggtatttggctctgaatgtgttttaaattttaaattgaagagaattttctaacatttacccattttaaagatgaaatattataggactaaaacttgtaagggccacttttctgtgattacaatcaagcgaatttcattgcagctgggagcagcctatgccagtatatggcatttcagagtctagggctgcataaggatatgtacatttaaacatgaattgtataattatggatattaacatgtctagtccaatatcctgggaatgttccctaaatgatactttctgcacagcactttgcttagttttcagtatctgaagaaatggtctgacttgctagccctgtggttggtagaaatgtatatttgatgggtttttaaatcaactctcactcagattttgaatagtcaggctttaaccctcagtgatcttcaccaagtatattcttgccaagggcttactctgcaggaggctgggtggtccgtcttatgtcgatttagaagatataagtgacatcaaggactcaaggagcctccaggctgctgctggacagaggtgtggataggaagacatggaggtagagaaacagtaaagaaaaacacccaaagcacaagaaaggctgcagtgtccagcagaatgtgatgacattgacatgagaggccctgacaaagttccagggaaagtcagagagggaaagaccagatccctttgggatgactgtaagaggcactgggacatttgagatgtgccttgcagaacaagacgacttccagggtcaggacggggagaagccttcagagcaggaggagttaccatgcaccagcaggagggtgcgggaggtcggcagtgtgcacaggggctgagcttactgcagggaaagaatgggagagtgagggccacagtcaggacaaagctggcagccaacagtgctgagcactcctgaaaggccaggcagggctctaagtatttctttttgtttgtttgtttgtttattatactttaagttctgggatacatgtgcagaatgtggaggtttgtcacataggtatacacgcgccatggtgatttgctgcacccatcaacccgtcatctacattaggtatttctcctaatgctctccctcctctagcttcccaccctgctgacagtacccagtgtgtgatgttcccctccctatgcccatgtattctcattgttcaattcccacttatgaatgagaatatgcggtgtttggttttctgttcttgtgttagtttgctgagaatgatggtttccagcttcatccatgtccctgcaaaggacatgaacttattttttttatggctgcatagtattccatggtgtatatgtgccacattttgtttatccagtctatcattgatgggcattagggttgattccagggcatttgtgttggttccaagtcgttgctattgtgaacagtgctgcaataagcatatgtgtgcatgtgtctttatagtagagtgatttataatcctttgggtatatacccagtaatgggattgctgggtcaaatggtatttctggttctagatccttccatggctctaagtatttcttaatcctcacacaggcaggctttcttgctaacctctttagagatgaggaaagcagggtgcagaggttaagtaacacgctgaggacacaggcttcagagaggggtgaagctggcctttgaagctaggttgtccatctctagaagccacacccttaagcctctgctgcaggaggtgggagttaaacataggcaatgagaagtcattgaatattttggttttctgggtcctgagctgcactttagaaataccagtctggcagtgatgatcaagtgactaattcaaagggtattttgagagactgagtgaaaggaatgaagacctggaccagcatggtggctgtgggaaggggcaggagagacaccggtgcaagggagattcagcaggtggaatctggggcttgcactgattggatacaggagtacagttgcttaaagagggagaggtgagagaatgaggacgccattgttaggaaacaaaaatcaggagatgtagctggatttagggagaataatatgccttcagttttggatgagtcagttctggactgctctcattccaggagatgttggaaacagagactggatccctgaggagatgctgttagtgagcattgattaacaccatgggactctgaataggcagtagggtaactcagaggatgccaagagagaatagaaagatataataaaggaggatgagcacaagaccttggggaatataattacaaaggatggggaagaagaaaaacccaccacgctgcaggagagtgaactctcagagaggcagatagatgagcaatgagtctgctgacccactggtaaccaacagtaggaactttctgaggaagacacagttaatggcgccacccttgactcatatatcagagaagaggagatggagggagttgaagggaagaaacagtggaataggaaggcttggtagcaccttgccaactcagttcagatgaaaagcctgagagaaactgagagattatcatttggctggcagagcagagttctcagggtcctggaagctggctgtcttcaagcctattaatggttaatgtttctcatgctcttttttgctaaatttgacaaacctattccccttcctcctcaaagtcaactgagttattcactcagttaaatctatcatgacttaaaaagtatatgcttagcttggagagggggttacatctgttcttgtagtcacataattactggagacatgaaggaagattccagcaactcaggcgccttctgaacaggttgaatacctggtttttatgagcaacccgcttcagttttctgagaagctctgagtaactacaactaaacaagtctattcttgaatatgtttataataaaaaaggaaagataatgcagttatttgctaattgctgcaatgattaaagcaagatgtttcaagtttatcctttcataagaccagcagccttttgaacacaaacaggatctgacaaagatagtaataatgaaagcgggagaacaaggaaacaatgccagttttcttcagaacaatcggttgccactgacttctaacctacctacagtttcaagtttctttggctgggactatattctggtttttcagtgctgtactgtgattaagccaaacttcagcaaaaaaggaagtgctgcattgtagcagtattgaaagttatgtaggtggattttttaaaaaaaatattacagcctaaattttcttagcaaaagtcaaatgagtaacaacacacagtttggaaacatttggagaggagaaaacaaatatctgacaagagtacttaaaatctgaaaaaaaaaaaaaaaaaaaaaaaaaaagaaagtgggaggagagtgagaaaaagcccctgacaggtaatggtggaaacctgacaaatggaaggtcattctaatgagagaggcggcctggtctcatggaaagagactttggcctttggaatctgaccttcctggatgtgaattccaggtgtgcagactcctggcagcaatactcttgggaaaggtgcactaatgttctgagcttcaatttcttagtacattatggggcatatgggaaagagacagaggtgggctacttctctctccactccaggatgccaccctcccactgttccccaccttccttcttccccaggaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggcagggaaattcctgccacaggacaacaaggaagttaaatgacatgattttttgtgaaagtgttgtggaaagcacttctgtcttctatcttatgaatcagtagggaatgagcattctcaaaatgaccagaatgattcctaatttcctttctaaggacctgattcccttttcatacgttctttttgttctaaaaacaaaacaaaacaaaacttactttgtaaagaaagcctgaattccagagccagagtctgtccgttaaaaactttcaagctttttttttaaacttataaaaggcgttataccctatagccactcaaacttgtataaacaagagttgcaatgtgaaaaaactcacttgctgggtttgcctctatgaacaactattgttgtcaatgcaaattgaatccgaaattacccttgtcattgtttttttctggggttgcttctttcatttctgttaaaaatacacagaaacattaaaaaagtaactatctcctctgttttataaggagaagaagggataaagaaaaagaaaatcaacttggcatgcaagtgagccttgctctggaatttgggtgggtctaggaaaaagcaccgacctcagtggaaaacatatatgggtgtgtgggaaatccctgtaaactataaattgactacacagtgcttaagctggtgtggagagaaaccacaatactctctgaaaccagagaggaggggacagagagcaagttttgcacgaggagagcacaaagtgtccctgggagacagagctgctggtaattcttagcaggcttaactggatctattgaaagtgaccactgtaaaacaccactgttgcaccctggggttctctgtgggatgcccctacttgtatcatgcaggaaccctatggcctgactctgcttcacccacacttcttcccaccgctccccagcaaggccccccgccctgttcaattgctcctgtatgcttccccacttcactgccattgcctttgcagctccaattcctggaaagcattctttcccttttctattagaatctcattatgtagcttcgaagcccttcaaggcctgtcaagactcagctttcccttcccgatggggccttacctcttctacactttctaaatgttatcttctccaggctgaacaaaacctagtgtgtctctttgctactaaggactaatcagatgctgtgtcctgattcattcggtgttggtgtatcccatatctccaatcagattacgagcccctggagggctgacagcacgttggacttggctgagctagaatcagctcccttttgcaccctgagctgagtgcatgcagctcagcatttgtaatcctagcctaatgcaatgtgaaatttattatctctctttttacaaatgaggaaactgaagatcagggagacagtgtgacttgtccaaagtcactagcccagttgcctttcagaaggcatctcactccatcttcaggatgaccccaggggctaggctttcacactttaactcctcctagaaggtcataacctgaagatctgagatttgaacccaagtctgtctggctcctaccctgtacctttcccactatagcatattgcctccctatcaccaaaatgcccaacacgaagttgaacatggcataatatcaaatgaacttgtgatcatcccgttttgtcaaaactaagagaacataaaaaaaaatcagcaaatttgaccagagcagtgtatttatggcaagaccaaggcaaaacttgattctgcattctttgcattatagtaacagactgaaaaggttcataagtgtattcatatttaagggagtgtgtaactgttctacctgggtcaatgtagaattccctatacgttgcatgcatcatcaggaatttcatatgcagcagataggcatacagcctggtttctccaacagccaaaggcatttctgagtggcaacaacactgatctggtgaagctgagtccatctggacattggggagccccaggccagcagggtttctgctaagtggacctttccaaatcctctcagggacaaaacctggttgggcatcttcaagaaaagatgctcttgtaaagttggtgtagctgcttaaataagccccgaatagagtctagtccgtctctctgtgcttttctttaaatttcccttcatagaaagctaaaacttaaagaggtttcagagaagctagtctgaccccatctcccagtatcattgagaaaactgaagctcggaggggctgggtcatttgccggaggttttgcaggacacagaagagcttgttctcctaatgtggcctagaactcttcaccaggcctcctcctatcccaggtggaaactaaagaggaaaagatgaagccaaactcaggcggaagcaacataattaaactggtttatcgtttggcaacagagatcagaggagtgagtggaaagtgaaaatcagtgaaacacttgcagtttaaaagaggcatgcgattcctgcttttcctaagcagttgaaatgtgtttatatgtctttcctggagctctctcattgctaatgtggtcctataaggggaagtcctggagactgagctgggtgtatttgagtattcttctcaatggaaggcaatgagcttgtgtgctacactgcttaggccacacgatcccccaagcctgggctgccagacgtcgccatcattgttccatgcagatcatgcccatcctgtgcagaaggtcactataggaacacatggcacagggaagaaaacgcccatagaaattcacatggtgcttgtctaaaccgaaggcaggtgagatccacccactgtcatgggaagctgctagcatgctcccatttgtttataataatttctccaccgttagaggctgctttaaaaagaaacggccaaaacctgcgatccggtgccacaattgagacagaaagcatgggaccatgacagttttaagaattactaaagtatgaggcttgaccagatcatttttccaaggatccagagccctttagagagaattcaagagggagaatttctggtgacttctaccacctctgaagaattaaaaaacttacttgtgctgctttccaggcctctgtggtagttaattctgcttggcagtttttgttgtcaaatagcttttaagaaatctggagctatctcagatataaataccttaatgatgccagaggactgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgcgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagtttgtgaaagtttaaagaatgccctcaatccatgaacgagagggaggatgttgtctttaattatttagaaggtttttttttccttgtctgttgataattttatggaaggttgctttagatctccattccttaaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgatttgaaacttaccattttcctggaaccttaactattattactttgtacgtaatactttcatgttactatgctaacaaaggatttaggtagccaacttaatttattatatctggtcggtcttctgcttgaaacagattcacactcaacacccaactaaggaggagccaaagtagtggagtattcctgacccaaaaaggcttttgaattttgaaacatttctaatgtgttaggttttctcaatgagaccattaaaaaacgttgtgttccatttgagaaaccagagtcaacagcagtaaatcagtgtgccccacaagccacgtcttattcagcaataaaatagtgctcacatggtgcctggcagacagtggctctggacagcaaagcactgagtcacccaaccccactcctttgggatggggttgggagtcatgcattggctccctttttcatcctggggaaattacaacacaacgcagagtgtccagaaatctaaagagctggtttaaggtgaaaaaaatgccatgaatgaatgaaccagatgtttaataaatcaaaacaactattttgttggatttttatttgaattaaatttcccaatttttaatagactgtgatttcaatattatcgaaatgtaaacaaagatatatttttaaggtggcatttctactccagcatgaaaaaaatagtggcatttgcactctagcattattctgtctcccttatttgagtcttcaatatatatgcccagctggagggagaagaagagaaaaatgaaagcactaggcctttgactaggtttggttctatatgctgtcatgatgttcaaaatgtcagacatttgaccacatggcacagtgaatactctcacgctctcaattttggctttcattcttgctagacttttcttctattaaatttctgaaataactagttttttttttttgaacttgaaaatcagctttttattttttttaattttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtgatgttccccttcctgtgtccatgtgttctcattgttcaatttccacctatgagtgagaacatgcggtgtttggttttctgtccttgagatagtttgctgagaatgatggtttccagtttcatccaataactagttttatcatagctttccatgatgtaattttttaagcgaaaggtactaacatttccagtcttgatttccaagttttgtggtgtgcactcgaaatctagtctctgattgttaaactctgggtaggtacaagaggctcttaattttcttcctcccaggaggacttacttacacttaaaggtcaaaagcttaacattcacttctaaatggttaactgcatacactttaccctttgtaaacttcaatttatctttttttttttttttttttttttttttttttgatactgggtctcgctctgtcgcccaggctgctagagtgcagtggcgcgatttcggctcactgcaagtccgcttccaggttcacgccattctctccctcagcctcccgagtagctgggactacaggcgctcgccaccatgcccggctaattttgtttttgtgtttttagtagagacggggtttcaccgtgttaaccaggatggtctcgatctcatgacctcgtgatctgcccgcctacaagccaggtgtggtggtgcgtgcctgtaatcccagctactcaggagactgaggcaggagattcgcttgaacccgggaggtggacgttgcagtgagctaagatcgcgccactgcactccagcctgggcaacaaaagtaaaactccgtctcaaaaaaaaaaaaaaaaagaaaaagaaaaagaaaagaaaagaaaataaacgtggcaaaactagaccttcagacacttcacttcacttaaccctatggccctccttatcttgcacccaatttcttttcaacatcatacatgcttggttgactgtttcttcatatttgctgttcattctataaagtcaaatagattggtgggttaaaaaataatcaattcaaattcaaattaggaatttatggacattcagatatccacatatttgagggcaggaatttttacttttcaattggtatgttggcagtgtgtaaaaatagaagaccaagagaaggcggttgattggagttgatacttaatagctaataaaaattacaagaaaggatggtggaagtcaaaggacagaactgatacacgagtataaaagccaacgatgtcatatatgtaggcaaagtctttgtaatctgaatataatgccagagagctagggctgccaggcactctgtatgtgcagaatatgtcctatatggagtaattttttatttgtgtagacttttttaggataccttaaatgtcttacatgcaacctttttttccccatatattacaaaattgccttggaaattagacaaatcttcaaacttaactgaaactcctgtcctgaatagttatttgccaaatctgacaaatttacaaagagtgttcacataatcccaaactatgcccatttctacaagagaaatacatgcctctttatttggagtttatgatattcatacaactagtagtagagtcagggagtattccagaaacatatttccctggcttgcccaattatcaagggaaaatttcagctgaacacggggaacccagtctttgacactcctgtgtgcagtgtggagcagcgtgcactgtctgagtctccatagtgaggaatggtcttccctggggcatcaccctagaaggatgggctcaaagtcgccctccacgtgggtgcacaggagcccagattctcaagccccagttgcagaattaggctgatggttttacaaaagagtcctcctaaaagtccatcactaagttttgtttggttagcaacccttgccacatgatgtagtacttagctataattttatttttattcaaggccaaatcttatctggtgtccatgccttcccacctacttaaaatttcaaatttcaccctcaaaaatatttcagtaaataaaagttagatctactcaaaattagactccaagggaattactatagttgattatagagtatctatttccttaaaaaaaaaaaaccataagttgttgactctgagctaggaaatgcgtgatctctcagctgacttactttatgcaaatttacttaatattatagaagagtaaagagcttccaagaaggtgattggagggaagttcaaagggaagatttttttcattcactgtagttttagctgtattctttcatctgcaatcaaatctcaggattaaggatgtcgtattacatcaaatcattacaggaagtatgactgtatcagcggctttttacaaaaacaaacctccagatcacaaaaggaagctgtgtttgtgtactgacacgaagtgttacgtagcagccaggagaggaaggatagcagccgacttggatccatttttgaggaattatttctgtaaggtgtcatggaattgtaagttacaaaaataaggcttttgtaaacagaatctccattccagaaggacggactccaaaatgctacttaatgaaattcatgggaatgttatggtgatggaaatcccaaatgacatgtagattttatatgcaaacaatcccactgcttgtaactcctggcagtgtgtacttaccaaaatcttgatcacacttaggtctcttgctatatatagaaccacatctgatccttatacagtgttgcaagatatatgtccttgctttcccatggttcttaagtgagtcttaagcttggatttgctccagcagaatggtggtttgtgtttctcaaggctgagctactatttggtgcatgtcggaaatctcacactaactgtggatactctgtcatcactgaacccaatcatacaatgaccagacagctttaaatacctacttttgtatgctatgaattcatccgtttacttgtcaaatcctttatttccatatgtgtctccatcaccttttttttctctccggataaatggaattactgtaacttgtgaaacaatggcaaacactataaagctaattttacagtcttgagtttctttttgtttcactggaatggtaatggtgttacagtggtgctctgacagacaaaaaatctaatatgtccttagaaagttcagaggggaacttatttgaaataaccttttccagtgatggcaatcacaataatgtgggaatgactaggtcctaaaaacttatcaaggtgttactgtatatcagtacgtaaagaaatgtattttgcttctttccaatcactgaatagaaaatgaaatccctgcctcatcgctcctttttttttttttttttaagacagagtctcactccatccctcaggctggagagcagtggctcactgcaatctccacctccaggattcaaatgattctcctgcctcagcctcccaagtagctgggattacaggtgtgtgccaccacgcccagctaatttttttatttttagtacagatagggtttcaccatgttggccaagtgggtctcaaactcctgacctcaagtgatctgcccgccttagcctcctgagtagctgtgattacaggcatgagccacggcgcccagcctcatctctctttttctgcctgatgctctcctgctccagaatgcttatttcattttagtcaatgattaaaaatcaagcaaccgtttaataacaaacatcctttcagcactgcaacccttaccaaagtgccttttgtgctattgctcctttacttggatggattaaaagaaagaaaacacttaactacataagtcctacaggcattagtatgggtgtcaccctaaagccgcacacctaattaaaacccacgtagccaaggagtgcatccaaatggcagtagttatcctccaagcagtttcctgggaaaactacacacacatgcaacaagatagttgccacagctctgaacattccagagtgtctctcttagagccctctcctttggagccttggctcattctttgtaacattctcaggggtggccaagctttgttcttggagggagcatgtgacagctggaaataaacaaggctgatgcagatagtaggaagtcatctttgaggatactgtttgaacaaaaaggcaaaatgttttctagaaagtgcacagtcatctgaaacacagtcatgaagctagccggtgggacacattttattaattttaatttgcatggaagttttcagacacatgttattttctaccccgttatctcaaacgtcaattgtccttccaggatgaccttggctgagaactgagctaaccacatccaagccataaggcagcattgctttcaccacaccatgtccttggagcagagaataagggaatttgtcatagcaacatgggaagctttggttctgggctggatacgcaacatcccggcaggcataatttcccttctcagaaatcctgtcttcataaatgttagacaaacaacttttatggtttaatttttcatgcaaaagtccatattcttcccagaaactcttacattgttcaagtgattatgttctaaattagtctattcctttactggaatttaacacttgcataataatcttagctgataaggtatttgagtgatctaaatgtgttttcacccgtcctaagggctgctttctgcatctttcttagtttgcctctattgagtctgccagaaactcttactctttttaagattttgttcacgtttttattttatttttttattttttgagacgaagtatccctcttgttgcccaggctggagtgcagtggcgcaatcccagctcaccgcaacctccgcctcttgggttcaagcaattctccagccacagcctcctaagtagctggtatcagaggctcccaccaccacacccagttaatttttgtatttttagtagagacggggtttcgccatgttggtgaggctggtctcgaacacctgacctcaggtgatatgcccacctcagcctcccaaagtgctgggattacaggtgtgagccaccatgcccagcccacacatatttttaattaacaaataataactatatatagttagggattacaatgtgatattttaatacacattttagaataattatatcaagctaatgatatatccatctcctcacgtattttcttttttgtagtgagagcatttaaaacccactctattagcagttgtactttctcttgacagtgtacctctctgtaaactctgtttaacgtgcccactcagcatgtgatttaaagatctgcaatgaataagtccactatgaccaacagactcacagcctcacagcagcccagaacagtgtgcttctccttacccctacccccacagtaagtctggctgacctgctacatgttcaaatatgttgtggcatgttctattgcccgcgtgcctcttctgctcatacaagccccacaccccccaaacacacaagtctcatgacatctggtcacatcttagatatccagagagcaagaaatattcatatttgtagggctctgaatgctaaaaacaacttcaaatattcaatagtccatgttataccccatgaaagggtagaggaaggacatatgcagttatctacactttgcagaagaccctgtagcccactgacatcacttccagagtggcccagtgagccattggtggcaatctgggtcttttccttcttttcttttctttttttttttgttgagacaggatctcactctgtcacctgggctggagtgcagtggcgtgatcacgggtcactgtaacaacttcccaggctcaagcaatcctcccgcttcatcctcctgagtaactgggactgcaggtgtgcgccacgatacccggataattttttaatttttttgtagagatgaggtctcagcttattgctcaggctgatggcgaactcctgagctcaagcgatcttcacaccttggcctcccaaagtgttgggattacaggtgtgagccactatgctcagtctggattttttccttctggcctagtgttttatctccaaaatttacaacatggaaatctcatggtggagcagatttccatgtgagatggatcaaaattagggcaaaagtgatagcagaatagataacccaggtgaaagcatgagactgggagtctggataaattgcctaaaggcctaacatgcttcaaaaggtctgttatttagaggctggcaacatgagataaatatcccgaaggtagagaagatatgaagtgatcaattgaaaaggaaaaggcagaggagtaagaatgccattcatcaagacagaaacagaatccacatccctgctgttcatctaagcagagacaaacggttgaccaaagactagacatggggtgactaagattaagaaatcctacagaaaagtcaagatgaacaagcattcagttctcaagtcctcacattcattatgattgcatcatatgaggctcagaaaagttgagtaatttgtccagttacccatctaccaaggcgtaaagccaggagtggccaacataaaagcctggcttcctctccatgttttgtcctgcctcccaggtgggccattacagggtgcatccaaaaaagcataggtgatttggtggttgatgctcttggagccaaagcagcatttgctttgtgctcaagtgtttccatcaagtgaaaacaaagccatggttgaattgcggtgtcaccacagacgacttgcgggcgttgaattcatgcaatgcaaataataagggattgtgccagtgtgcctcccattgtgaatagagcagtgagctttcaactgaatgttttgctgagttctaaaaacctgatttgtaaggatttatactgggcttctcagagaggctttagggtaggtaattattttaaggtcttggctgattgagtcaagcggcaaagagagctttgtagagacaagcaaacactgcagaatcagtgcagctggctggaatccgatactgagcttacagggcctaaagggagcaggtgagtggtcccagcacaagcagtcactgcaattacagtgaccaggcccggggaaggaaggctcaagacccagacaccaagaaaagctagaaacacagggcaagagaacaaggggtcttagaagctgactctagaaagatgttctgacagattgctcttggcactagggaagacctgcctacaaatctctccatttcacaagcagataaataaagaggggcaaataggagaggagtggagtatgaacccacaacacatgacggagatcaaggaagtagagcttcaggagcagagacccagacccagggccttcaaatcaagggcaggactctgtccttaataggagtcaggaagaagggaagcaagacaaaaatcctactgcagggacagaaaaatgaaggctggaactcaagtgcaaagaggctggccaacacaggaaaggaactgggtaaaatactggggcttcctcattggaaagaaggatttgtggcaagctggacctggacaaggtacacttgttaaggagtcaatggctcgtaacatcttcatctctcctcagtaggaatcagagccggaaaccacaatttctatttcagtgcttcccagggcaagaattggcagccagaaggcaagcacatcatcacagcctgaagtgcatatttcatcatcagatgaagcggtttctcgcatcatttattatttacccagtcactttaacaaccacctgatctctgagacaggtccgtggagtgttgtggtctccacattaatatttatttagcgatggacattgtactaggaaataaaagcagattcctaaaagagctatgttatttgtatttttcgagggctgccataataactgcaaacggtggtttagaacaattcattgtatcacatttctggaggtcaaaagtctgaaggaggaccatgctccctctgaggtattttcgctggtctctcccagcttctagtaggctcaggagctccttggtttgtaggagcataattctataattctaatctctgtcttcatgtgcacatggtgttctcacatcagcttccctttgtgcctgtctctgtgtccaaattgccccctttttataaggactccagtcatgttggattagggaccaccctaatgacctcattttaatttgactacctttctaaagatcctatttccaaataaggtcacattctgaggtactagggggttagggtttcaacatatctttttgggaggatacaattcaacccataacactattctttcccatccatttcatcaccaattgatctaccttcaaccttccttctaatcagaatcatactcatataaataaaccagaataagattctttgctttggaagagacagaagctttctctgggttactgtaactgtcctgaatttcctatttctgcagaatggacagaaaaagctgacttctagcagacattctattatagtttgaccatagccacatgggaagttatgccagtggacattcctttggagacagtttctggttcttagtgcagagagcaaagaacattcttccttggaaattgcctccactattttgtaaacaggagaggacttttcaaacctggttttcaaacagccagagactaattgtgccctctccaagttaatcatatactgggcttcctctctcaactgctctcacaaagcttgctgatttctcaatagcactgagatacttgaaaataattgatttctagatgcctttcataattctggctctgccattgtcgtcattttgtgtctcctactataaaggttagggaaaacccttgcttggcaagccagcaactcaggtatgttgcctcaaggtgattctgcatccatcactggaccaccagctgaggtccccacacttgctttgctttgctgagtcaagtcgcaccccattgttttgagaataatgctcttatgtgttgcatttctccccaaacctctcctcatccagtgccggaaacgtgagagctacccttgctttctcccactccctcatcacctgtatctaattcatcacaaatccccgtccacgctacccctggcattgctctcaagtcagtttcttctcttccattctaatctcccggtgcttagttctggccaccatcatcatcatcatcacaatatatgtttttaaaaaggcacatttcacactggctaccctgtttctagtctttctccttcccaatctattctccacactgtacccagtgtggtcattctaaaatagaagtccgatcatattactctttcactcaaaacccaacctccagataaagggcaagtgtccagacattggactcatgcctctccttgatcttgctcctggtaacctcctcccttgtcatctctttcccttgcgctctactttcaaacatcctgaactctttgcaatcccccagtgctgaaggtttttcctcctcctgcagcctctgggatattggttatgcttctcctttctgggatgctaccaccccaaccctggccaactcctgcttggtctgctggctgtctgtctgaatggctttcttgacagtgcctatgtgattctagaggaagggatcctgccactctgttgacttccccatggtgcacaggacctgatatgggatggggggcagggaagtgccgggcaaagaagagcagagtccctggtgagggctataccctctggcctgtgcccacggacctaaatgaggataggcatttctggttttgagttcaaaaagttgccttttggcctgccacaccccttcccccatcctatgcctataaaaatctaggactgtagcaggcacagacacaagtggctagacgttgagaggagcagaagaacacactggcaaacaccagcagacactggcaggccagtgacagtagaatgacatagacacgaagagaattcagtcaggggtggtcagagaagagtccagccgctggatggccagactccaggggaagatcgctttcccactccatcccccttctgactccccatccatctcgctgagagctacctccaccactcaataaaagcttgcactcatctaagcccacgtgtgatctgattcttccagtacagtagggcaagaacccgggatacagaaagccctctgtccttgtaatggggagttgtaaacactcacccctaggtactgccatggggttggaacccaaacatgctccccgcaacctctgcacctgctcatctgcatgctcccactatggggctgaacagtggggttccaaagaagcgagcaacacccctgttacatgccctgcaagggggataagggaacttctccggtttcacatccacctctcagaaggctgtcctgacatcatgacctagcctgccatgcctctgggtagcattccatctctggagccaggccttccaactgggctgctcccaggcccttgcccactctggtaagtggctccccactggttcttctgataagaccggggtgtggtgagtgagatagggagacacttgcctcagggacaatatttgtgggttgctgaaaaactcagtaatcaagattctattttaatggatcagtaagagtgcttaaaggaatatttatagtttcgggtgtttgagaagaaaaaaaaggtttcttctccagccttaaagagtcagaaaaagaagaataaattgaacccaaaatagaaggaagaaatcaaggaaataggaaatacactaacaagagttctgtttccagcaaaaaaaaattatcctcccacagataacaactataagtgctggaaaaatacataaaaccaactaaccaaggaccctagagagtgaaccaaagcaagcacacttcacaggagagttgaagttcacaggaagcagccagcatgggggaaattctcatttttttcagctttaccctaaggatagatgcagctggcttgtgtcagaggtcaactaaagctcctgtaaatagctcaccatttttctggctcatgaaaaaaaagagaaggtcccaagggcaatcagggctactggagggtggaagaaatccaagaaagaagagcacatgaaatgggaatccctaactttgtgcataaactctggacaagtcagtgggtgaccaccgaaccgtgcatagagagggcagactgcaccagtccaaactaagatcataaatactatgtaaccactggcaagaccaagcttgaagtttaactctaacaaagtttaactctaactagccctctaagtgaacatccacatactttgtaaaaagagaatggaattcagaatctctacaacatatctttgacaatgttcaggatacaattcaaaattaaaagacctatgaagaaccaggaaaatgtggcttactctcaagagaaaaggtagtcaagagagcctaaccctggggtgatcctgatgttggaattattacataaaggttgtaaaatagctgttaaaactatgctcagtgatttaaagaaaatatgcaataaatgaaaacttaagaaatctcactaaatacatagaaacatgaaaagaaccaaattaaaattttagaactggaaaataaaatacttgaaataaaacttttactggatgaactgaacagcataatggaggtgaaagaggaaaggataggtaagttttaatataaatcaatagaattatccaaactaaagacaagaaagaaaaaaagactaaaaaaagtttgtcaaacaccaggaatctgcggtataatgttaaatgtactggcaaaaaaatcccagaaagagaatggggcagaaaaaaatatttgcaaaataatgacagaaaataaccctcatttggtgaaagagaaagatgcacagattccagaaactcagaggaccccaaacaggagatgttgtattatatcaatatatatagattatatatgcagaagaccattttaaaaataatcaaatcaaactgctacaaaccaacaataaagagaaacctttgaagagagcaagaaaaaaattctacattacatgcaggagaacaatgattctaatgatcacagaatctgaaaagagaccatggggtgtagaagatagtagaacaatattttaaaatgttaaggggaaaaaaaaacttgtcaatttagattctatttccagatatatatgtttgtttccagatatatatatatatgaaatatatatatatttctatatatatttcatatattcttctgaaatatatatatatatatttcaagaatgaagacaaaatgaagacattttccaaataacagaaaactaagaaaaattgtctctacagacccacagcacaaaaaatattaaaggaagattttcaggctgaagggaaataaaatgtcagatggtaactttcatcttcaagcaggaagaaaaagcgtcagaaatggtaaatatctagggaaaaacctgttttctcttaatttatttaaaacacatatggatatatttataattctaaaagtatcttgtggattatacatctatatgtatgtggattatacatatatgtatgtatacacacataatagcataaagacagtggggtagtgaatggatatacacacttgtaagattcttacattcatataaaatgatacagtttaactcgaactagactgaaaagttaagaatgagcatgggatcttcagagaaaaccactagaactgataaattagtttaataaagtcacatggtaaaagattattataatcaattgtatttttaaataccagcagcacaaatttggaaaataaaagctaaaaatttatttatgatagcttcaaaaataaaatatttaggaatatatttgacaagatatatctacaacttacaactgaaaaatacacaacattacagagagaaactaaagagcacctaaatacatggagagataaaccatgctcataggttggaagactcaatgtggttaaaatgtcaatttccccaaattgattaatagatttattacaatcccaaccaaaatttcaaccagctgttttggagaaattatcaaacagattctaaaatggatgtcacaatacaaaagactcagaatagcctaagattttttttaaaagaatcattttagaggatttgtactaattatgtcaacatttattgtgaaggtgtagtaatcaagatggtatgtaattacaaaagggtagacatttatcaatggatcagaatagagtccagaagtagacctacacatataatgccaattgaattttggtgaacatgcctgaaaaaaattcaatggggaaaggagagcctttccagcaatggtgctagaataaccaaatcttcatacggaagaaaaaaacactacagagaacctcacatcacacacaaattttaaaagggattgtagacctaaatgtataagctagaaatacaaaacttcaattatgttttgttattaggtataagctagaagtacaaaacttcttgggaaaacatacaaacacatttttgtgactttggggtaggcaaacatttcttaaacaggacgtaactagtataaacaaggagaaagatgatcattggattttatcaaaattttttaaaatttcctaagggaaacaattaagctaataaacacaaaccacaacattcggcaaaactatatatatatatgacaaagcacttgtatccagaatatataaagaagtcctgcaactgaataagaagacaaaaaagtcaattaaattgtaggctgaagacttttttttttttttttctgagacggagtcttgctctgtcgcccaggctggagtgcagtggcgccatctcggctcactgcaagctccgcctcccgggttcacgccattctcctgcctcagcctcccgagtagctgggactacagacgcccgccaccatgcccggcttattttttgtatttttagtagagacagggtttcaccgtgttagccaagatggccttgatctccattggcagaagatttgaacagattcttcacaaaaagaagatatatgaatggccaataaacatatgaatacattattctacatgattcgttgtagaaatgcaaattaaaaccacaatgagatgtcacgataaatccatgaacagaaaataaaaagactagcccaattgttaatgggtacatggagcaaacggaactctcgtatactgctaaacagaatacaaaatagcacaaccactaaggaagactgacaatttcttaaaaagttaaacacacatattgtaagactcagacattccattcttaagcactacccaagtgaaaagagaacatctgtccactcaaggacttggttgggcagtcatcccttggcatctgaaggggattggttccaggatctccttcagataccaaaatccaaggatactcaaattccttatatcaaattgtataacatttgcatataacctacatctattctcttatataccatctctagattatttataatcataatacaatgtaaatgctatgtaaatagttgtttactatatttgattttgaaacctattatttttattgttgtattctagtttgtattgttttgctatttatatttttgatccatggttggttgaacccacagacacagagggccaactgtacaatattgttcatggaagccttcttcataatagccaaaatatctgtaaaccacctaaatatttatctattggtggccgggcacggtggctcatgcctgtaatcccagaactttgggaggccaaggtgggcagatcatgaggtaaggagttcaagaacagcctgaccaacacggtgaaaccccatctctactaaaaatacaaaaaaaacagccgggcatagtggcgagcatctgtaatcccagctactggggaggctgaggcaggaaaaatgcttgaatccgggaagcagaggttgcggtgagccgagatcgcgccactgcactccaacctgggggacacagcaagactctgtctcaaaaaaaaaaaaaaaaaaaaaaatatatatatatatatatatatatacacacacacatacatctatcaatcggtaaatggataaaaaaatatggtctgcccatacaatggaatacaagaaaaatcaatgatctactgatgagaaaaacaatatgatgaacatcaaagccattctgctgagcaaaatgagccagaagtacatactgtatgatttcatgcacagaaagttaatcagaagttgcttggggtcaggagtggagggagaaatggactgaaaggaccttgagcaaactctgggagcaatgaaaatgttctgaatcttagttgcaacgacgattcacaggtttatacatcactcaaagcacatcaaccaggacagtttaaatagatctttatcttacttttaccacaataaattggattttaaaattaatgtgcatgctaatcactagggagctagttgaaatggaattctgatccattagatttgggagtttcctaagtttccacatgtattacaagctgccaagtgatacccatgctgatggtctgagttccacacttaagagaagcttcagactacgattattcaatccccaaatgatgaagccgaggagcattttatgaattctcttctcgggtgtgattaacattacctctctcatgcttttagagctgtgtcatgtcccggaacttcccctgacgcgacattaatactctgtgaggttgctaataacaatcacatctggcatttacaaagcacacactaagtgttgggtaccgttcttacagctgtacatgaatttacacatttaatccttgatacaaaagcaggtactattactatctcatattgacaaatgtcaaaacaaaagcccagaaagtttatgggacttgcccaaggtcacccagctgatgagcagatgaggtggattcaaacctaagcatcccaaactcttaagcactgtgctctgtggcttctccttggaggaattataatcctctgagtgaggaaatcttcctgctttgccacactttatggagggctttactggttcaacatcaaacattgttgattgagcacttgccatgtgtcagggatttacccaggagttggtggtctgctctgtgcatacttccctgaaaacacatataatcctttgcctactaacccagcattggcagtgcccactctgtgggttgtttgccaagaatgctgactgtcattactttgccacctccctccattctcccactgggggagtcacaggtgagcagaagcagcctcatacgtttccctagtgtcagagccagagctatgagacaaccaggctatgagcatctagggttttgttgtgcttttgtgatctctgactatcagaaatatggagcgttgttcagatatccctgcaactcgaggaaattcatttaaactaaagcatgacagctgtcagtgagatgaaaggtagagctgaatctggagctccttcgtgcaggcctgtcgtattattccattctcatgctgctataaagaattacctgagactgggtaatttataaagaaaagaagtttaattggctcacagttctgcaggctggacaggtagcatggctgggaggcctcaggaaaatttcaatcatggcagaaggtgaaggggaagtaggcacgtcctacatggctggagcaggaggaagagatcgaaaagagaagggctacactcttttaaacaaccaggtctagtgagaactcactcgctatcatgagaacagcaagggggaaacctgcccctgtgatccagtcactcccaccaggcctctcctccaacactggggattacaattccacacgagatttgggcaaggacaggaatccaaaccatatcacctgtcaacatttccatctccttgaccaagtgggagtgagagactcctgacccctctcctggaataaggataacataacccagggcttcagagttgtgagctccatgtgctagcttgttgcagcaagtcttgcagaagttgagtgatggggacagagacccagcaaaggctctcctaggagagctgcatgatgcattaacagtgtccactacagtacaggagcctttcaggagagatataaggaggagtttcctgagcaggaaagttgttgatcacaagaacaggtgagcaatgaagacaaaactaaactggagtcacaacaactcggatataaatccaccctgaggcaggggactggacccattgagctgccagagcccttatatatctataagttgacttcagagagtttcaaatccgataggactttgcaagtaccatatcgaagataaagaagctgatccaagggaacgttggccaagcccacttcgcagttgagaacaacatggcttaaaaacagcctgcacagcttcctggacgtcccatcacatttgccaaatagcattttggtgagctgagaatcaatgaatgagaaacagatggatttaatgtcccttgaaattagggatgggtgagcccagccacactgtggaattgctgaatgtctcaaactatttttttcaagtatctttggttcagaaaaaccaaaaccatggttttgcaaagcacgtttcctctcattcatatgagggttcgtgtattttaacggaaatttgatctgcatatttcaacttctttacacttcacttatcaaaatgctaaataaaatttccaggaagtctgagaaatatttataacttttttttccaaactattttatttaggaaaggaaacaatggggaagtttggaaaatcctacaaaagagaaggtgggttcaggtggaagttcacacttttagggagttctatgtcccagaattacgcacatgttaggtgtgcagtcacaatgtgctcaacgagtatatttgaaaatctcttgaaaagtgaggggaaaggtgggaaagttcaataaggacaagcttgaggaaaggctgaaaaatacaacataatttaaaatagcttctcatctctaatagccaggcagtgtattcctagcagccataaatctaatgacgcagaactatagcattcttgtatcatccaccagcatgaactccaccattcttcagatgtcttttctctttataagacttgtgataaaggtgcttataggatgctcatgagtggagggatggcaagaggagagggtggaagaaatgcaccacagagggtgggtgggagcaggcggtggagtgagtgcccagcgccatctttgttttagagaatgactctgaccacagacttatgtgtgagccctgaagagctgtttctacttaaagcttagctttcggttccagaggaccaagtaagacacaagcgggagagacgcagtcatcccatctctcagggagctcagtctgtttgtattgtgctggaagcacagtgcttgctcatcaccgacaggcagacttctgctcatagtgtcattggcagagagtgcagcaatggacactgcccaaaaggagagaagaaggaaaaggcaactccttgtggtatctgattacgtttgtctcaaatgcccaggagacattccctggggattcccagaaaagcaatttaagatggggatttgacagggagcaataataattattgatacaatctgaagaataatgtttattacgatgaatatgcttctcatttaaatccccaggctggtgcaggaagcacaaacatggattacatatctctttaaagccatgtattttctggcttttaaattagaaaacccaagtagggttgtgtggcagtgacaataggagttgtcaaatattcctgggactcccccacatttcccagcagccttccaggtagttaggttggtggcagtgattgatctgggccaacagggtgtgggcatgaatgatgtgtggcattttctgaccaagatagtcaattcttccattcctccctcccctcctcagagatcttggtctacaatttgcccagatgttttagctaaactggacttctcacaaaggagaactgagcttttactctgtaaaaccactgtgatttggcgggggcgagggtggggggtcttgtttgttacagtggctagtgttaactagcctgattaacacaagcgttaactagactaatacaggttgtaaacttacaacctgtcattatgataccctgatagtaataaagctggtggtttggggtaagattctcagaagtttttgagaatatagtagtgccttatattagtaatctactgctatattaaaaactaccttaagaggtagtagtttaaaacaacaagcatttattatctcaaagtttttgacggtcaggaattttggagtggcttaggtaggtggctctgactcaaagtgtttcatgaagtgcagtcaaaatgctggcaggagctgcagttatccaaaggcttgattggggctggagaatgcattgctcatataggagccctcaatttattgctggtttctggctggagttctcatttcctcatcagatgctcctctttgtaacgattctcaggcaagggaagctagcatcattcagacagagtaatccaagagagaaagcaaacaggaaaccacagaatcttttattgcctagtatctcatgttgcttcctcccccacctattcattaacagtaagtcactcagtctagccacactcaagaagaggagaataggttacagcttttcaagagggtttcaaagaatttgtgaacagattttaaactaccccagagtgggtacaccccattaccccagagtgggtttgtaggtagctaagggggtagaatggtgggtggcacctaaggtggggggttcagtgacccaacataaatcaggctaatagagtgtaatggtgtgactgctcctatcttacattattccttaatcgcaacagcggatgaagggaacccagccaattctattcaagcagcctggactgggcccctgacaagcatctgcatatggagatgccaaggtaatttgagatggggattttctacagggagcacagagaaattcctggttgcttacctctgtgcatagacatgatgcagaggaaatgaactctcatgaaacaggacattgtgccgtaaccaggcttgccctggctgtatagggaggtgagttccggcattgtcctctgacatagccccctcctcccaacctcccagcttgcctggcgctacatagtgtgctaattgctgatagaaaccctgggagtttgcagaggaggataagatagatcctacagaaagagaaattcttccctttgcataaaacctgtgcaaatgaagctgatcttgatcttagcccatggcagggaatggcagtaacactggaaatattggctttgtgaaggctggaatttttcatctttcctcctatattcatagtgcctatataagtgtgcactaaataaaaagcaccttgctggtattttttaattaattgaatgagctagcatttaccatggaagaaggtgtggtggcataagagggtgacaggagttctaggtctcataggttcctgatgccagaaaattcaccagcccagccatactgatggcagccttgcaccctgaggaaatggttgtgtgagttcctatgaaacaataacattgggatctaatccaattatgatatgacccactcttggctgagcccaaagtgggatctgcaccatggggcagggaaaggaccagagataaaggctcagtttatgccactccttctcaggctgatggtgtttacttgcatagccataaaaagcagccactggggacagtgggagagtgtggtaaagctggacatattgcattagcttgctaatcactattagcagcagtgagaatgggacatttccttagactccccggatttggacagcaacagcaggttctggggccacagtggtggtacaacagagctcccctgagccgccagtgtccagaatgtgaagtcctctagcctagggggaacatagcttctcctactaggaactgataaggaggagccacagctcagcaatgggaagggtagacttctttctcatcttggcatgggcttccctggttgaaacaccagctggtgaagcatgacatactggtttgagttagttttattttatctttaagaggacttttaactggaccatcacccccaggaaatgtttcatgtaaagaatagccaagaaggccatagattccatcccaccaatgacacacagcaactgaccattcacccccatatcctgcactggattttccatatggccaactcaagtacacatattgctttaccaagtgatgctcatctttgcctgcaattaccaccgtgattacatttctcctcattagcctagatgggagggtgcagggaaggatggttggatcaggagatctagttaccatactccgacgctgaatttgctgggtggctctgctcaagtcagttgacccatctgtgcctcctctcgtggcccttgttcagatatgcagtgattccatgactgattttcagtgttggtctcaagcatgtagctgccacttggtgcagagcattagcatatctttgtaattgctaatgagggaaacaaaattccagaaaagctgtttggaggaacctaagaataacactatgagctaagcattctgcccaaacaaattttgttaaaagaaaaccaaattattatccttttgcaaaataatagcaataatggccttaactaacatttgccaggctctaaatatgtatcttgcggtgtctaaatattttacacattgttttcattccctcctgttcaccccattggtgagggagacattccacactagaattatgaggatgaccaaacacattacactcgatgcttaacagatgcgattgacggcagttattattcacatacactcgcagcttgggagaggtgaacacagcatgggatgctggccatacaggggttgccctcaggagcagggtgaacaggcaggggctgtgggtggcaagctttgtagcaacaagagggtgaggtgctccctggttcctgcaggagaatgtgatgggctttgaacaattccgaggttagcaggaaactgatacccactactcagggataagtaggagctgtgcctggtccacttgataaggtgggttgcttgactggagccttatctgcaagagtagaatggagagaggctcttgtgggtaggtcagtagaggtactgctgatttgaccagatttgaaggcagcacactataccacgcctcaatttcagcctttacatgacacacacatcgtattatttcatcatcgcaacactcctatgaaatatcattaagcctttttacagatcatgaaattgaggcttaaatgaggccaagcaaattgcccagtgtttgctagctggcaagtggctgagctggtattcaaagccaggtttgttactctcagagtctgacctcataagcaactgtggacaggtagatgtaacaacccatcttagacatgaatcaagaaaaaagaaggacaaggggggaacaccctaccccaaataaccagagagctcaacttaaacacacacagtcttttgttctgtccaccatgtgacctcctgagtcccaccgctaccttccgcaaggcagctgggttaataaagccacctcagtgaccattaacagcagcagctctgcctcacactttaatcagtggtccctgaagtgcttacaagcccagctgctcgggacacacttttgattctacagcctggaggaagagaaaccatccaagcagatcaaccatttcccaggtgcttcaaattcccaaggtcagagacggcaccagtcagtcatccttttgcatgtggatgttgggtatgtcaaagggacttgatgttctggaataaattcctttacacagaaaagaggctttagatctctttcagtccaaaaccttcattttatggttaaagaaagtaaagtggcctccccaaggtcacaaagttggttagggcagaacctgcttggatcccttccctaaaccctttcccaacttcctcctcccatgcacacctcccactctcaagtggaagaaaggagaaactctcttcctcagcaccctttgcagttaggctgaccatgtgacccgttccaggctttgtgccaagagggaatctgccaggaggagtctgggagcagtgtttcctccctgatagaaagaaagaatggccgggcgcggtggctcacgcctgtaatcccagcactttgggaggccaaggcgggcggatcaccaggtcagaagattgagaccatcctggctaacatggtgaaaccccatctctactaaaaatataaaaaaattcgctgggtgtggtggcaggcacctgttgtcccagctactcgggaggctgaggcaggagaatggtgtgaacccaggaggcagagcttgcagtgagcagagatcacgccactacactccagcctgggcgagagagcgagactccgtctcaaaaaaaaaataaaataagataaaaataaaataaataaataaataaataaaatttaaaaaaaagaaagaaagaaagaaagaaagcatggcgaaagagctctctcaccatcctctccaacctctacctcctataagagccagtgaaggacctgaggcttgaaaccagaggtgtcttttagccatgagggaaagttcagagatgcggacacagcaactcagcctcatgtggctgctaaatcaacccccaaactgcccttcctgactcctcatttcagtaacaattaatccaagtttaaaccactgttagtcatgttttctctttgcagccaaacaccctcctctgagcagcagtcactagagttaggcagtgggtgaatacccagaaatgtcactcactagcaaccagacccagggcaagaaacttttctctgtctcagtttccttttttggaaaatgggcatatatttttacagaggtgctgtaaagtagtgctccccaacctttttggaaccagggactggtttcgtggaagacaattttcccatggaccaggggtgtgggggtgggggaaggtttcaggatgactcaagtgcattacttttattgttcactttattcctattattacattgtaatatataatgaaataattatacaactcaccaaaatgtagaatcagtgggagccctgagcttgttttcctacaactagtcagtcacacctgggggtgatgggagacagtgacagatcctaaggcataagattctcataagcagcatgcaacctagaccccttccatgtgcagttctaaatagagtttgctatgagaatctaatgccgccactgatttgacagcaggtggagctcaggcagtaatgtgagcaagggggtgggggacgactgtaaatagagataaagcttccctcgctcacccatcattcacctcctcctgtgtggcccggttactaagagtccaggactggtacccatctgtggcccggcaggggggagtggttggggacccctgctgtaaagcttaaatatttataaagattgtataatattttctagctcacaattgactgttagctattattatttcattattctctcagcctactttcacagaggctctccaacacagagctcctcaaaacttttgacaatacagatgaattacctggcaattgtgtttaaattcaatttctgattcaaaaagtctgccgtgggcctaagactgcatttatgaaatcttttagggtatgtctgtgctgctggtgctcagatcacactttgagaagcaagactgtgggaccctctgggtctgtttcctgctagttcagccttctagctggtggatttgcactaatagtatgccccaaccttctcgttatactcatggaagctctttcctacagtcagactgtccttacatccagcagcatattcatgaaattctaattcctgggcttagccagtgactcagaccctccttctccaggtctaatggatgtcactgtcaatcacaatgtcaccctcaaaggcccacggtctagcctagtcagagggaactggatgtacagaaagacaggtatatggaagaaatctggggctttttgaggatttcattcaaagcaggatgcaaaggttcatatacttcaggactggagccacttgggggccttggtctcaggatgatgtatgttatgataacccccaggactagaatccattaattcccttgatccagcactgtgctccagccctgggacaggcttaaagtttgtcctgacccagttcatctcatctgcctgcctgtacttctgtcagctgcctgtgccagatgttttattcccctccttccacttgtgaagaagctcaaaacctgcgatgagctctacttccttccaaggccagtcttgccttcacatacctcttccccttcttctccctgtactctctccactgggtctccccacactcttgccccccagtcctgtgctttgctctccatgttgctgaagttcacgttctttccttccagattgtaccctcaattcctctcaatcgattttgtgttgcgtgactaccatacagtaggtaattcataaagaaaagatatttataaaatttattctcacagctctgaagtctaggaagtccaatgtcaaggtgctggcatctggtgagtgccttcatgctgtgtcatccccaggcagaggacaagagagcaaaagagaaggagatggccaaacttgcttttataacaaacccactctcatgataactaacctactcctgcaataatgacattattctattcatgatggtgaagccttcatggcttaatcacctcttaatggtcccacctcttaataccatcacaatggccattacatttcaacacaagttttggaagtgcagtgttttgattatttgtccccttcaaaaagtatgttgaaaagtctcaatgtagcagtattaataggtggggcctttaagaggtcagtgagtcatgcgggttctgccttcatgagattaatccatacatgaattaatggattaatgggctatcacaggaatgagtctgtttaaaagccagcgtggctctcattttcacacccttgccatgtgatgtcttgagccatactgggattctccagagagtccccaccagcaagaaggccttcgccagatgtggccactcaaccttggatttcctcagaactgtaagaaatgaatttattttctttataaattatccagtctcagttattcaattttagcaacagaaaacagagtaaggcaggagggggacattcaaaccacagcattccaaccacggcccccccaaaactaatgtttttctgacatacaaaatgcattcattctatcttgatgccccagaagtcttaactcatttcagcatcaactcaaaagtccaaagcccagagtcccatctgaattagaaatcggggagactcaaggcatgattcatgctgaggcaaattcctctccagctataaactgtgaaattaacaagctacatgcttccaaaatacaatggtgggacagacataagatagacattcccattccaaaagggaagaataagcaagaagaaagagataatctgctttgactccatgtcctgggcactctggggcaggagttgggttcccaggaactcaggcatccttgctcctatggctttgctgagttcagtctacctagcaggtctcacgggttggagtgtggcaccagcagctctcccaggttaatatttcaagctggtagctctacagttctggggtctcagaaatgaccctggctccgctaggcacagcacagcccctgcagcagctccaactccacatttagactcagcattgcccgaatagagctccctgtgatggctctgcctccatgacaagtctttgcctgggcccccaggtagactgtgacagcctttaaaatctaggtggaggtcactgtgccccacagctcttgcattctacatgcctgcagaattagcaccatgtagatgctgccaatgtctacagcttacaccttttggagcagtagattgagccacaactggggccacttgaaccacagctggagcagtggagaatcactgcaccaggatgtaaaaacagagacccaatgtggccctggacagtgagcctgtagagggcatccaggcccatccccaaaaaccattctgtcctctgagagctctggacctgtcattgagggcagctttgaagatctctgaaatgcctttggggtcattcttccactgtcttgatgagcccttccatctgtacgagtctccttacccaacggtttgttggccacacccttggtttcctcatgtgaacacattttcattctgtaaatggtcaggctgaaaatttaaaaaatttttctgttctgcttttgttttaaattataaattccatctttaagtcatttttcccctcttggatcttactatatgcagttaaaagtagctgcacaactcctccaatattttgcttagaagtttcttctactggatattctagtcgggcactcttaaattccaccttctgtaaatcccttgagcatggacacaatttgaccacgctctttgccatttcataacaaggatgctctttactccagtgtccaaaaagataccctctttttccacctgagacctcatcagaatggcctttacactcagcatttctaacaacattctgatcatggccactcaagtaatctgtaagaagtttcatactctccctacagctctcctcttcttctgagccctctccaaaattgtccttactactctgtttatggaaatgtaggctttttctagcctactcttccaaattttttcaacctctatcgattgcccagttccaaagctactttcacattttcaggtatttgttatagtaacagcctcaattctcagtaccaactttctaaccattttgtgtttctataaacacaggttgggtaatttataaagaaaagaaatatatgctcacagttctgaaggctgggaagtccaatatcaagatgctggcatctggtaagggcctttgtggtgtgtcacccccatggcagaaggtggaaggcaagacagcatgagagagcaagagagcaagagggggtcaaattcactagtacaagcagcctactctcataaaactaacccactccggcagtaacaacattattcaattcttgagggtggagccctcgtggcctcatcacctctaaatactgtcacactggcaattaaattttaacatgaattttggaggggacattcaaaccacagcactctccaaacctctcttagcatcttctataagcctctagtttacaatatgccaaatgccactatggccccttgtttgaaacatgtttgtctccccagtcactgagctttctgaaggcagcaacagcctttcatcccagatcctctttctggctggacccctcccctggctccaccccaacctaacatgccttccaggcacctgtgtcactctggaggcggaagagcacaggcaattacctgtgtgatgtgtttttccatctttgtttcattgccttcatcaaccttctgatcaaggtagccagaagctgctgtatgatcaagtgaaaaaataaaatctcagaattattaatcacttctaatgtgctgggcaccctgataagaaatttatgtatgccagtttaattaattcttgcaactattatcgctattggatttctatcatctccactttacagatgcggaaatggaagctgagggcaggtaataggaatattgcctgaggttccacagccaggaagagaagcagtggagccaggagcccagcctctgttaacttctagcaaaatggctcaaggaaatatcagcacaaacctggttcttggctggcttctccttttcaccggtggacaaactggtggaaaagtggagggtcctgtttaaaagagagtagtttagttaaatcactgagttttatttcctcccaccaaactatgagttgttatggtaagatccctgagtcaatgccaatcttctacagtcctgggagcttaaatacacttggcaagcaacaccaagttatacagtttccaatacttagaggtatctgtgaatgcagatcttaatgcagtatattcttctggggctgcattttctgtctgaaacagagaatgtatcttagatgatgtgcttagcatagaacatgcttcatctcaggactcagttaggataacaacaaggcaggcacattggccagtgtcaagtgtgaaggtccaatttaggcccttactgtgttgaaggccgctgggcagatgccaggacagacacagaggccaggctccagcacagcgtcaggggaagtccatgccagggtgtacttgatctgatctcccacataacataaatgatcctagagacgaaggtcctgccaagagatctccaggtgactccaggagtccttgaggctgtgaatctttgcaccatactttaaatttctacaaagccccaaatgcctgtcgcctcctcagctccttttgtaaaggaacatgggtaaaccatggaccattaagagtagacaaagttttgccaagtccttggtgctatgtagggaagagcttctcagaatgttctactgggtccctctagctgtggagtagggcaaatgagcaccgggggtctggagggataacccgaagcagccccataacttgcatggaatgtttttgaagtcttgtatttatcttaataattcatgagaattttacatttctttccatgctatacccatgtctattttatattaaatgtagcattaataattgcccgaaacctgaaaaaaatggtgccccagaaagctgtacccacagttctcctgtagctgccctgggggaacataggccccagttcaaaagcaccgatgtatggcattaatctcactgattattctagaaccttctctggcccacacttagaaaaaccacaggcagccaggggcttgaacctaagcaacatgcacacaagttcagacccaacaaagggaagaatttccaggagagatttgtgcataggctcaagaagccttttagaaaatgaacaaacaaaatatctcatcataagtcagggacacctaatattttggattctctgaacactgatgtagtctacagagatcctcctcagaaaaaaaaaaaaaaaaccacaaaacatttcttaggtctgtgtgtcctttagagatttctagcgacctgagaccatctgtgggtccctaagaatataaagattcccactgagatcctttgtgcaaaggtcccttgtagagggcatatgttttctttaaatgttttgagccaacgtctaaacattgagaaagttcacactgttgtctggatcctggagacttgacagctttggacctacatgatctcatggctccatggaggggaggagctgccgctgcccctgcagctgggattccctgtcccctctgccacaccacccccattcctccttcacagaacccgccggcccctgtggccgctgaactggtgacttgtcatgccattaggtcatcgtcggggacatcaggccctgacagtggccaagagccatctggagtccatgctagtcatcacgtgccccagctgaccttccacccagacctgctgcagggctgtggctggagaaaagctgggtcaaagaagcggaagaatctacagatacatccagtactaggagcattggttgcagtggaggagttcaattccccatatggggaatattctccccactccacttggaatggagccatgagggtgagtggagagtcagagtctgccgcagccttggggcagaaacagcttcccagacaacatcggcaccttcccttgggacggtggtggctgcagcaacaaattaacacaaatagggtgacttaaaacaacagaaatgtattgtctcacagttctagaggccagcaatctgaagtcaaagggtccacagggccatggcaccctctggagactcaagaggagaatctgccatttgccgcctccagcttctggtctctccaggcatccactggcttgcggctgtgtcactccaatctcttctttctgtctgtgttttctcttttgtctcttctgaagactcctgtcattggatttggggcccacctaatcaatccaggatgatctcatctgcagatccttcccttaattatatctgaaaagatgttttttttccagatgaagtcacattcacaggtactcgggattaggactcggacgtatcttttgggggtcaccattcaacccactacccagcttcttagccactggcatacgtcataggcaacagcagcccctaataacaagtatcagtcatggtggtggctttgccagtgttcatggtaaaaagtgccctccatgagccagacctgagtggggaggagaatacagaaccacatcgcaacttgacttggatgcccttggtaatgagcatgagagcccaaccggaggacaccaagaggtctctgggagagatggaggcacatgaaagaggtcctggaagagtcagtaggggctgagcctgatttttttttaacatgctgtgacctatttgcaccccaaggctgctgaggcctggggaagtgcttaatttgcacagctgcatcctcatgagagccctggtctcatctgagtccacctgcccatgccccaaatccaaaccagtgtgttccactctcatgctctgccaaccagtatgaggtgagccatccaacactcactgagcatttcccgtgtgaagttcccatgctggggtacccctctccctagagctctagatggagagacagagaggcattctccaatcacctgggaaaagtcagttaggtgtggatgccagaggttttcatcgtcctattcctgtcccttatttaaaaagtgagtgggctctgtgttcactgtcccctggtgggatgcagtagaaataaaggcagaaattgcccagctttggtcttctggaagtctaagcccctgggggatttcagagaatctactgagctggcaaaataaaagggcttaggggtatgtattagcccattattgctataaagaactacctgaaactgggtaattgattaagaaaagaggtttaattgattcagttctgcaggcttaacaggaagcatgactgggaggcctcaagaaacttacaatcatggcggaaggtgaaggggaagcacgttttaccatagtggagcaggagggagagagagacaaggggaaagtgccacacacttttaaatgatcagatctcatgagaactcactatcacgagaacaacaaaaggggaagtccaccccccatgagccaatcacctcccaccaggtccctctctcaacactggagattacaactcaacatgagatttggatggggacacagaaccaaatcagatcagagtagaaacaaaaaatactggaccaataaacagaaggaacatttccccagatcaggcaattttccccaggtcagggagatattctcctggggtgtggggaggagactgggatagctcagcaaggtcccaggaaggcggcagctgcctggtcctcttaggtacttgagaaaggtatcttcaccccaaatggggctttgaacctcaggcctaattgccccaagggccagtcaatggactgtaatgtatatagactgatgatgaggcccaatgaggaccagaggatccactcctgcccccaccccactcagcagttccacaacctacatatgtccctgagaccatgatctggtcacagagtaaggaaagtgccttggtttgctagggctgccccaacaattccacagactgggtggcttcaacaacagacttttttttttgtagcacttctagaggtcagaagtccaagatcaaggtgtcacttggctatttctgaggcctctctccttggcttgtggatgactgtcttctgcctgtgtcttcacatgggcttctctctgtgcctgtctgtgtcctaatatcctcattacaacactgatcatatggatttagggcccactctaatgatctcatagtaacttaattgcctctttagtggtcctgtctccaaataccatcacattcggaggtactggaagttagaacttcaacagaagaattttaggagtccgaattcagccctttacaaagaggaactttcaggaaatgatccagcttggtgaagaaatggttctcttgaaataaaatttaagtaaataaaaaacacagatttctcttttgtacacacctcgggatgtggactgattcatgcctactggcccccacaggtgccttttccccaggcaggaaggtacagatcctgggaggggcatgattgtgtttttgttttttattttttaaaggaaatctccaggtgattttcagtccctcccacagaggcccactgctgtgccaagtgggcacagggcaaatcccaaagctcttgctcagttataagacaaatagtcagtaggtgccttctataggcgaagcgttgtgcaaggcacctggaggaaaactaaagtatgtggcctgcccttacctgttatatacagcaaggcgctcggtcaaagcaaagaaagcccaaaggcattcccaagcttggtgctccagacctccctgtgcactcacatgcctgcgctctttactctcatccaggttctttctccctccctagatctgctaagaagtgtatatggatgggtcaccttttccaaagaagggtgggaacgtcctcccatcaagggaaacaagtgtcctgtggtggcaaggaataaggagagtgaggaatatgactttgtggcaaatgctttaacttggacgtaagagctaagtctggcattgctgcaattgaatggatactattgtcccaactttgcagaagactctgcgtatcttactttgggatcccctgaaagtggacctttggacaaagattttctatgcaagcagtttcttgggcagggatccaggaagcacagtgagggagaggggaacaagtgctgggaaggggaggggatcagtagaggacacgctagtcagtgggctactgctgcaggcgcatggggctcagtcccagtggggactctgaagcctagggccatgagctcaagtaagcatgcattggaataaggagaatgcccagaccttgtaggattgttggtcatagagtctgaattgacattgatagctggggacatacgggagccaggtaatacatggagtcctggcccaggtctagcttacagtggatttgtttgactcatagaccactgagtggttgttttcctaatcactcaatagagagttggaatgaaaatgcttggtggttgtcaaaagtctcacattggaaccttgacctgtagcataagagttttaataccggggaaagccaaatagaaacccaacccctgtccttggtcaaaataatttttaaaaaaacaaaatgcatccccaggagaacaatggagcttagtggtaccagcaaaaatttgaagaaggcaagggtggtatcattgccatatcccaatttaatctgttagggaagcaggagcccaggcgagccaaagtgacaccatttttaaatcaattccatcttaaaactggcaaggcatatttcttgccagtcacgacccatggtcctgagatgtttacagctaaggaagcagcttagtgatgctacaaggacacactcctacaacaacaaaaagtccagatgtcccaatactcatatatgtttccaagataattatagttacgctttgatgtacttacacactaaaatgtcaaggatagttttatttaaatcaatagaataattttgtcatgctgtcagcccacccgtatgtgggcacaacttggtttagtctctacatagacaagacccctatataaaaaattaaacttaaaataaagatgatacattcctctgcttgcttcctgaggaatgtaatggagtagtttctaataaacttgcttctttcactgtgctctgtgacttgccttgaattctttcctgcatgagatacaagaatcctcttttgagatctggattgggaccctattttccagcaacaaatccatcagtctggccactacagaaatcagagggtcatggagatgacaacgggctatcacaaactcaagcaagtagtagcatccattgtagcaagtgtgccatacgtggcaaagagagattaacacagcctttagaacatggtgtgcacaggggtgctgcccttgacctggaaatgtgtactttgccctatgtatcagcaaaaaagaccagaagtagttccccttcatgtaggactgatatagatttctcctgaggcctctttccttgacttgcagacagccaccttttcactgtttccttacctggtctttccttcgtgtgcacacatccttggtgcatctccccctccttataaggacatcagtcatactggattagtgtgctactcttataacctcatttaatcttaattacctctttaaaggccctatcttcaaatacggtcatattggaggttaaggcttcaacccatgcatttgaaagcggagggacaaaatttagtctgtaagaggcaccatggcacagatagacagaatgactcagccagctatgatcagccatctcaattctggcacaaggagctcacagagtagctaaggtgacagagaaggagattcaggttgtgcctggacctaacagcaagggctccctctcatcaaggctgatctagctttggctgctgctgcatgtccaacccatcagcagcagaggccaacaatgacacagagacctgtctagcccaagtgcgtgccccctcccaggggacgagtgtcgccaatgactggcttctgcatgggtatgtaggtccagccccttttcttcaatttgggaaaactctgatggatcattccggttatggagctcctgtggaagcaactgaggtctcagtcatagcaccatcacaggtcagcttctctctctgcccagttctgccatcctcactcccttacatgtgtatctcccaagaacactccccaataaacgtcagcactcagctctcagagtctgctttcaaaggacctatgataagacagtaacctttctaaaactgatctgagaatgagcctgcattcagaatatactttccccactgtagaacactggtgcccctcatctactttaaatatttctgtggcttattaccctagttgaaatacacacctggcattctacaaaaggaatcgaagtattgtctcaaaagactatcttcataattaatcaaggcccactgagccatagggcctccagcctttccctaactgagggatacttctgctaatggtgaagcttggtgttaaaaataatgtttagacctgttttgtgatattctgaatgtagaacagccaaagccatttagattagtgtcatttgttctcataaatgtgaataaaatgctttgtgggactaccaaattctttaaaacacgttacataaaatgtgcagataatcttaagagattccttttagagttggtgtgtttcattcaataaacttgttttatcaaatcacataacatttatttaattgtcaccaatcattcttttatttcatcatatagagtattgcatatttgtcttatttatttttttttttaccaagaaatgaactttctaaaacttatgaaaacatttggacggtagcttacaaaaatacacagtgatagatagatttttccttattctcttaaggtgtatgtggaaaataaagtacaaagatcaatggagaaactaatatcctcctgcctgcccatgttttcaagcaattaataaataagagaaaagaagaagcaaagagacaacaaaaatatataatgacatcccttcacatggggtgggggagaagcaccacctcctctccaacaggatacccacaccttccagattatctgggtagacctcaaattccaatactctgatctgccatcctcagaagatcacgtaggactgtcagataccttgttctctttggggaaagggtatagaacacagagtcccagtaatcacacaccttcttacccagcctacaatggcttcagagcacagaggctgcagtgcccttggcttcctgaccaggcgctcctggttggccttcccccagcacttcccagcagacctggttcctggtagtgacgcctttgcttttcttccaggtctatttttgtccagagtcgccaattccccaccacaagtctccgttcttttcccccaaggaccttcattggtttccctaaaggggttttcccttgcccaatcctggtgcctttgagtcacagccggcatccttgccagggggccaccagcccattctgctagctgaccaacaatcctgtttttgggtctaaggaaaagtgtctcatgtgatcatcagagcttgagccagaggacatatatgggcagggcttagaccaagggccaaaggcaacaggccccaagtgagggcagagatgtgaagtcatagatagtcactgctgctccaggcacccacctgggagagcctgcattgccccatgagtgaccaagtggtcccattcctctggatatagcaaaattaagaaccttagccatgaagaggtcaggaggcttaaagggacatttctgaagttggggcctttgcacttgaagttatccaagtagttgagcattagacgtcttcctcttaaaccttgtacgctctccaccaaaaggtttgaagcctggtaaaactcttgaaaaaatgcacaccattgtggtagccatgtcttcaattagcccctatccatagagcaacattttagctcagtgactgcaaagacaccctctcttcttattttatccctaatgcttaggttgctgctggctaatacttagtattaaataatttatttaatactaagaagaattaaataaatattgatggcatgaatgatcattctgacttgaaagggcatttattgaactttttagtccaccaaacaccataagcccttgatttttatttcttctgctctaatttctcagagcttgtagatatttcctagcaggtcatcgttgccacctgggcaagacaggaaggctaccctcatcccactcacttgttctccttttgatcatatactctcatgttcgccaatgcatcaaattggtgaccttcttctaatcacagacaagtacaataagattggaaggtgtcatgttttggcaggtgaacctgtttctataaggatcctgaaaagaccaaggtatatttattaccctcagtttctttccttgacttgctctttgcactctgatgggccagccttggaatatctccaagagcagctgttggcaggtctttcaccccaggaaaaaattatcagctctgtattactcaagttgtctctaaagatgttggtcattagccacttcactctctctcgcctgcttgtgaaatatgggttggattccttctgacatgttacatccccagttgatctcctaaagcaaataggaatttatggagacattcaacccaggagtttatgacctggctgggagggaaaatctcctgcacaaacatcttctctaatttttttgtatctttcccatctcaacattcccacttcccaaagactctaatgaaacagaagcacagtttttgattgagcacccagtctgtctactataatactctctggatcccttgttaccaatatatttataatcctatttctaactaaggagtttagttataagctaaactccagcatttcctcaggaggtgctggcctcataaatgtcctgcaagcaaggaaagtagatcttccaggaatggcaggaatcacgagaagactgaagggtcagctctttaattggaccacctcaatcgtttgggctgttaaacaatatttttgctcagtctttcccacattatagtaattaaatagttccttccacatcctcaacaaagtcaaacacagcagcttcactgggtgaaaaagaccactcttgatttgggtgaaaaatgttctttcccacccgtgaggaaggccaagcagcgaatcctcccactgctgagattagagcagttatttctgctaacactgccatcccttctctctccagaacactttctctgttatcaagttgagcaaagcaaggaaaaagtaagctggtcaaatgtttacttggttggtgagcgttgataaaatgttggcctctgtgtggttctggatgagacatgcaccccctgacccagccagccctgggctacaatgagaacgaaggagcaggtgatagctcttaaacaaccagccagtcccaggttttcagcccagtgtttgttcacttatcccagacgcttgactcacgagggaccgtgtttatactggctctgtcccagggtcactttggttgagtggtatccattggtgtggctcctacagcaaaagaccaagtcctgatgccaagagagattaggagtttgcaacgggaaagaagaggaataaacaaaaaagagtggctccaagtcaagtaagttgctgagctgacttgagcttgtttctacttgtgggaaactaaaatcaatctctggtctggttgaaataatcttcagactgtctgaacaccatagttggtggcacagatttacagacatctcagcagattggagtgcagaagagcagagagtaagtgggttatgagccagcttaaagcttcactcaatggaaactggagccccgtctttccagagaggcaaaaaatgaataataataattgtgatgacgatgatgatgatgagacattaaataaacctccttggagctttttgctgacttcttctgctggtgcctgcactttctgcctccctagaggttccaacaaaccttctgactctaaaaggaaacccttctgagaccaaaaggatagccaattatctcaagttttacagcataaataatctaattggatactaagaggagtccagatatttgcacaaaaattaaaccgtcacacagaagggtgttatacccctgcctggcctccttcttcctaaaagcctggagagtgaacagacttgagtgttgaacgacccccatttcctcctgctctaccatgagtgggcaccatggcctcaggcatgggaccaacctctccatatcctctcagtttgaggagggaggtgctatccactgtgcctcccttgataggagaaatcaagcatgcattgaagcccttgacaaagaaaaaattgctgaacagaagcaaggtctgcaggacatgggtcctattgctgctgggcattttgcaaggataaatattacatagtcactcagtttggtaggaagtttgctcacaagaattggaactggaggggctggaaaataaaaactccaatggaaaaggctaaattccttttatcttcattctttattgttaactacttaagccacataatcccctcagtgtcaggtatcccaggccaagaatcctatatacccaggcacatcgccacccctgcaccaccaggccacataatactagaaattcattcagaaaaactctttccagattgattaattggtgattgaataagtgagggaaggaataggggaaagggcagaatcagaaaatgagaagcgaacgcaggaagacaaaattagcgtggcaggtacaatggcacctgcccagatcccctctctatggacagatggccgcagctgccaggagggccattatacccttcagaagtggctgcagttgcagagagatgcctgactagggcatcccacaactgacagatccaggcaggtgtataaaggtaccactgggtcattttaacccaatgctgaacaatgctgctaagccattttagctcctgagcttccctggcatccgctgaggctgtctcctctgcatcactgctcagctcccacctctgtccactcaaacttttcttgtcctcacttccactggtgtcgatctcaagggcaccaaatatcctatcccttaaaatccattaacaaatatcctatcccttaaaatgcatctcagaatctgcctccagagaacacgactgtgaccactaggaaatgtagccaatggaaattctcaaagactaagaggagaatgaagaaggcaggggacacactcatcttctttgtgctgtcattgccattccttgtctgggtgtctgcttcagcaaggcactggagcacagtgacaaagaaacatgtgttaggttcctgggacctctttctcaccttagttttgtcactcacgagctgtgtggtcatggataagtcaatgtctcagggcctctttttgcaagttaagaaacaaggacaataatgatcctacctgacatttgagtcatcatgaggatctcctacgaccgtggatgccagtgtgcacgggagatggtaacaccccatctgctagtgacatttcccccttctccagccaaagcttggaaagacagcaggaccttgaaaatggcagccagaaaggcagccatttccaccctgagcttcaatccccaggctgaggaagtccttgcagggaggagttagctgctagaagtcatgggagaggggagggtactatctcattaaactctcacccatagatcatattgaacacctgctacctatgtgttaaactccaggccagtccacacacatagggagatggaaattaactaaacctgcaaacaaataaaaacctcccacagggaataagccaagtaacaggagttacagaaggcctccctgaggaagtcacacttgaaatgagaactgaatgacgagaaggaggtatgtcgacaaaggaggaagggaaggtgattgcaatctgagatgaatatgagtcccaagaagtcctcatggtcaggggagcagagagcagaaggcctggaacacgagggtgaagctgggagaagttgggaggcaagagctgaaaacgggctggggagaggatgagggccaagttgagcaagtcctggcaggtcaaagactattagctttatcctgaatacaacggggagttgtggaagggccttaagcagcaggcagatggttataccagctgcagagggaaggatggatggcagggaggtcagagtgggtagcattaacaaccatgagcattggttgatttactacgtgcttgacacagttctaagtgtttaaatgaagcacaggcacccaataaaataggtactattggccgggtgcagtggctcacgcttgtaatcccagcactttgggaggccaaggtgggtggattgcctgaggtcaggagttcaagaccagcctggccaatatggtgaaaccctgtctctactaaaatacaaaaattagccaggcatggtggctggcgcctgtaatcccagctactcaggaggcgtaggaaggagaatcacttgaacctgggaggcagaggttgcagtgagtcgagatagtgccattgaactccagcctgggtgacagagtgggagtctgtctcaaaaaaaaaaaggtactattaagatccccattttaaagatgaagacatgaaaatacacagagaacaaacaaacatgatgccaaccaagctgtctggctgcaaagccatacaggtaactacacaatactacatggtgggtagaccagatggacagctattttagtaatccaaatttgagtgacagcagtggaattggaaagaagtggatggattttcaagcgtgtaggagatcaaaagaaaagtcagaactcagttacactttggccacagggatgtggggagatggtttttgggagagtgatggggtggcagtgagagacactgagatataggggtccagaagaaaaccagggttgcagtatcaggacggacaggaggtcggggacagcatgagtccactgggacttgcagagatttgagatgtcccggtgacatatttcgtagtgttgtattcttttaaggatacctggttttatcctcctacaatattctggctctttctgtttgactacgatccatctggaatagtcacctgtttaatataatctggctcctgtgcacacaggaaaggagccactgtctcccttaaagtccccttccagaagcaagagtgtcctcacccctcctcagcccagcacatcctcatgcgaaatcatcacgggaagcaggacagtccctgctatgcaaggagagggcagttgagcatgagggctggttaagagaagagatttctgagcccgactccaagccctacgatttatgagttgtgagattatgtctttgcccaatttattaatctgtctaaacctcagtttttctatctgtaaaatatggttcttgagaggctgcaatgagatgatatacctaagagaaagcccagagcctggcaggcaatagccaagcgatggtagcagttattatccctagtggaaatcgcagcacatgaacactcttggattgttgtttgtttcacagctcgagtctctggaactggaggaatcccttccagttacctcctgttcttgcttttcggatgccgggggcctctcttgccagaacagcggtcatgagccatgagggcagtttctacacatcttcctagacaggatggcttggcttatgatctggaagatgttttgccactgttcagccacaagaatggttgtcatttgctccgttgcttgtaaaggaaggctcgtctatggcatttggttagtgagagcagcagtttagagaataaggaaagaagtttgtttgaagagagtctcagaaagtgaaaggtaactgttttacacagatgatggatgaagcgactccttttgcaataagcccttatctttccttaaagcttgttccaagggggaaagcctatcacctggcctactgtgattcttggagtctcctctggcaaaagaggtggcagttgtggcttgcctccatttcgttttctctgctgagacctccagaaagtcaacctgcctcagaaggtgcaggtcccatgggttgtggcccctcacgggatggttacaaggcaggcaactgagtcacacatttcgttgcttcccaggacactggagacttctcaccttgagggtgggagaggtctgacggtttgaaggaaagagggattcctacatactgcaggtcttggtagggaaaatgtctttgtttatgaagccttggcgagcacaatcatgagtgatttggggaaggatttcctggggaatggagactctgtgaaacagacaggtctcgcctcatttctctctagtccctggcagcagctgctcacaggaaagagtgcagggtctttgctaagattcactgaggttccagcactgcatagaaacaagtagctaagtgtcccagtaattgtcaccatctgtacctaagagaaaggaaaacctcacgtgtgaccatctttttttttaagcaatcatttcttgagagaataaagcagaaaaacctgaacttatccttttgcttgtactaggagaaagagaaaacgcaacaaaacacacacacctgacccctagctaacctttctcaggatggggatgggagggtcctgtctggaatctcagaagttggggcttcctaaggcacccctacacccccgtttcctggaatctgctaaaagaaaatggaaaactagccgagatatttgactgaggtttcttaagaaaacatattctcggtttgggttgttttctgaggggagggttggagcgatgtggtttaagtaagaaaattgctcatgaacagtgatggaaatagtgactctcttgactgttccacatgtctctggctatagttacaggaagcaaagtggaacagtgtttgcgaattacctggggaacacgggcagagtggacaactgatctaaaaggctggagccaagaaaacatcactgcatcagtgatctgggtaattccatggctggagcatgtgtttagttacttaagtggaaggtggggacgatcttatttcgggagcctggctagactccaagatgaaataagataacctacttcatctaatttgttgcccacactccctagagactaacgcatctcaggtctctctgacgtctatcctagtgaatctcaaaagatttattttcatactcttttaataaggtcagtcaaccaaaatctaaactacttgacttgactttgaaaatggttttagaatcacagttcatagtataagagcacaaacagtttccattatctttgaataaatccaataaataatattcacaaattctaagacacagacaattttagttgtttgaccaacagaatcagtttttctccggtgtatctttgtggttagcctttatgatgtcacgtttctgctaccaactatctattcagggaaagataaacagagggcaaacaatatttgtttataccttttgggctaaagacacaaaaattctgcttaattgccttcatcaatcagtagaagatcctaaattcctggggatcatggagctcaaatggttagggtgggccatgtgtacacagtcattcattcaataattcattcactctctcagccagtcaataagtgttgcacatctgcaaagtgcccggcactgggctaggctctgggcatttcaagatgaataagaccccacttctgaatgacgcaaagagctttccagctacacagtggcatttgtaatgtcacaggcagtccaaggagggagtggttacttcacagaagtcactagagaaaaagagtatttatgcagggcctacaaggatgggaaagattttggcagggagaagcagagggctaaggagctctagaaagatgagtttccaagtataagcaaactgaggaagctggaaatgaggaaaatggggtggtcagcatggctgaagcttgggaaatgcggagcggagtggtggcaagtaagccactgacaaattgccgagtttcttcagaagtaacgagtggggcttttctctgtagtagctgggaaccaaagaaaatgtgtgcgtggaggcagaggcagtcagggatctgatcggaaagttcagtgtgctgtcaggtgaggaatgcattacacaggtgggttggaaatactgggataggaggcaagagatacagacttgagcaaatgcctgagagggaagcagtaggttgctgagcagggcattgccgagggcaagaggagaaggaggtggctgtgcagagggggcaggccacccatctggactctgtcctggccccactcttggcagctatgggaccaggtttaagtggcctccagttcctctggagagagagaaggactgggtacagcagcccctcccccaagcctattgagacatctgtagggaagagagttcagctcactgggaaggagaagccttcaaggctggagagcgctgtggtgatgtggttatctaactttgctgtgggtcagaattgcctgggcagcatagcaagcggtcccatccctggaaactcagactgggctgcctttgtagctgcaccacactttggaaaaccctaatctcacatctggggtgttttctgattctctgtttggaggattctgaagctcagaggggctgggtgggtccagcctgaaaggggcacatcccatcacctctctctcctccaccattcacagggacgcccaacacgatgccctccgtgtcttcatctctccctctccacctcctcagtccctttccctggacttcatgggagcctgttgagctcaaaagatccccaagagccaagatgcaagcctgcagatttcaggacagctggtcctggcgctgctggctgctcgcaagggccgggcctcctcattgccgtcaccagcccccgttgggcctcatcagagcaagaccaggctcggctgatgctcggcgctgtattccttgacgcctccatgaggcttgctgcccagcatgtcccaggcttgctggaaatgctgaagctcaggctcacctcagacccacgactcagagtctgtatcttttccagatcctggagtgatcgcatgtgcacgtataaatcggagaagctttggcttccatagcctctgctggctgtaactaatccttcctcaccccatactgagggaaaagaaagaagggaagggagggaaaggaagggaagagaaaggagaaggaaggacagggggagagagagagagagaaagggaaggaaggaaggcaggaaaggaaagaaggaaggaaggaagggaggaagggagggaaggagaaagagaaaggaaggaagaacaggaggttaggagagaggaatgaaagaaagagaatgggagagggacagagggagggagagagaatgattctgtgagtctcttaactctggtcctcctgttacacatcttttcttctacttttcctttgtttcacacttaagctttgaagatgtaaagtaggaccagagggtgagaaattcaagaaccttgaaataaaagacctttctgtttgcttttcatttcctaaaaaggaagtcctcactgactgttcctgtaagggatattaagctgtgtggattgtgagtgattcgtcacacagcaatttggagcaggaagcacacgaaaccctagagctagcctgcacgcaactaattgaagccctcaattaatcggattggcttccaccttcaggagaaaagcaaatactaagaaaacaaattagcacctggaatttaacaacttcccttttttggtgtgggggcgcattatattcagagtacatgataactgatggctcgtctcataggcacagacatctttacaatcctctaaggcagagtggtgtggtggaaacggagttggcagaggcatcagatctgcccgggtttccatcccagctccagcatgcatgggccatgtcgcttggcaagcagtctcaccactcagagccttgatttcaggattaaaaaaataataacctattcaacagaatcatggtcgagaagattaggggtttgtgcaactcctcacctggtggatactcaaccggaatgagttctctttctcagttcctgcctacagatctatagacacttagctttaaaagctttgattatggccagttgcctggtcaacctaataccagcagaggagtgtattttccctactatggtggaacagaggtaaaggttttccaagtttgaagcaatcatacaaacaaaataggagcccaaagacttctgcggagctttggaatgagagatgcccattctggtttcagaaacgccagcgccatctcttggaggagcatgaaattgtttccttgggctgaagaagcatccatggggccccaggtaggttcagctggtcctctccttctttcaactgtagtttcagactggaaccccagggcttcttccaagggaaacattcttacttatttccttataaaggtcctgcatacctttgtttgtctctcttccaatcaaaccattctttctctctaatttcatcgggtccagtatttccaaatttcagtcccagtttgtaaatctacaactcaagccaaaccttcaaagactgaattttctaagtggttagttatccttctaacacagagggtcttccttctaacaccccagcagaggccgggtagcctagcactcaagatcctggactctgaagctagaccactgtgtttagcatcccctcagccttccaactgtgtgaccttggaaagttacttgacctctctgtgcctcagtttccccacccacaaaatgaggctgacagcagacaccacctagaatggttgttgcagcattacaggagttcacacctgcagcactcggtgcaggcctgtgacagatcatgagcaagtgtttgccatcatcttggttttcagtggctgttcccttacacaccacttacgacgctgggctaggatttcacttgacttgtccaggttacccaccaggcggtgtttctgtagcatgggcagtaaaggcagcataaatctaggccacactcacaaatgcacattgttagcacacaaaccccgtgattcagatgcaggtggtctgggggcctgatttttagagctgctgcactcagttttgtgctcctagggggcagggactagctccatccatctcagaccccagcctgcatgcagcaagcacccgcccccttgaaagtgctcagctcaagttgctttccttctccatcttctttaataaatgatcttggagtgaacaaatgggaggctgacagtattacactaaaataacaggagtttctggtcacctgagaagcacaatggtctctcatcttctccttactccattaggagttcatatgcctgcattttcctcattaaatctgaggtgcttttctgaactctatctgagaaggagctgaagtaatcaatgagtgtctcacacacaaacacatggaaacaggttcttagtgagagcggtggggactctgactccaaatttaatgatttttcactaaaaaggaatgacgcttcccttcactagaaagcaatgatgtcttcggtggttgcatcaatgaccaaacatgtataataaactgcttctttgaacttgaggacatctgattaagagatagaaagcaaaacaagccttcacagatggtaatagtgctgggacacatcaccttttgtgaataactgaagagcatatattaataacagaaatcacattggtgtgcccttactgaggatcgacaaaggagaacacgtctatgttttgtggaaacacgactgaagccttcatccaatgacgttggccggccccgctctcctcgtgccatcaagcactctacgctgactcagtagagcagcacagccctgtgtgtggagagattcccatgcaccatgggaagagggaccaagcctgggccctggagggcgcagccggtgcagtctgcaggaggctctgtgtttcaataactgtggtgtccccacaccccaagggccatctgtagatctgctgctccaaagtctctcacagtggctcttctttggaggtcactctccagttaagtgggggaccaactgcaaacttctcccatcaatatgaactgcaatatgatattgcagcaaacaaaacacacacacacacacacactctcccagaagcatttaacaggagaagtgtgtacctacacatttagtcccaagatctctttccaggccctgtccaggttcgtggtggaagcctgtcctctgcacactggcttccccaaatcttcccatattccagagcaggggaatcctttctccatcttttggctcagatctactgcggagtgtgggagaaatattaaaagtaatgatccttgatggttaaagctgccttatcaagttcctgcccctgggtttaaataaagtctctttttctgccagctttagataaggatggagggtgagagaaacagacagagacagaaagagagagagaagaagggagagaggcagagaagcaaggactctatagggaaagaaagagcttggacattaattcattttatgaatatttgttctactcttcttaagaacaaggtttgtcccaggtgccttgggggcaagagagaatttaaggggtggcaaggggccactgtcccgcatcttggggacgttgtaggcaggcaggtagagatgtgctaaggttcccgggtcctggagatgccaggcaagttggaaaatgcagaagaggaggctggggtggacaggggtcattttggctgaagctggttatgagaggcttagaaggtgaaagtgtctgctgtgctgggccctgaaatgtaggtcttcttggccacagtgggaaaggggagccctagaggtccttgaacagtctgagtgacaacacctgggctgcccagccccaaaggccaaaaccaagacacgtctttgtcccagaggttgggcttggtggctgcagctgtggatgctgaccctttcatgggcatggggacaggtgaaaagcaggagcgaggcaggcaggagtgggtgccagcaccagcccacagccatgaggcctgtgccaggccagcctgtggggacactgggtccccgagagagacatggaagctcccgccagcaggagacttgaaggtggtcagttctgaagtcctctcctccttaggcctggacctggggacacaggctccagccagcagcaggagcccatgaaactcatttgtcccaatcttcttcccaagtctcaacagctttcggggggttctgtgacagatgccccacttccagctccacagccagccctacgctaactctgacagatgaaaggcctcagaatccccttcttcaattgtactgcacccaacttgtggaaagcaaaacaatattaaaaatactttttaagaaactctagaatatattgtcatcaaagtgatcacggttctgcttatttttggtcatcgcaaccaatgtactgagccccctttgcccagaccctagcaggtcctgagtctcagcgtccacaaaacgaggctatggcccttggggagttccgtgcggtgccacaattggcctctgagttactctagagtgataaacgcagccttggcagtaaaataccagagaggtaatgagtgcggactccgtgctccctccgcaggggcaggtgcgtgaggctctagcgccacctcgtgggccgtgggattcgtgcccatctcctcctgggcgggagttcctctggagccaggaactctttgggctcagggtgtctttttagaaaagcttctgacgttggttcttctttagtggaccttctccggtaaaacggggttaacaactccaaacttttccccacctaaagggattgaaaggctgtttcaaaggaattagagctctgagactgcaacccacaaaacacacaatagcatatacacagagatgcacatagaaacatagacacacagggacacacaccagagatacacacacacacacacacggacaggcagacacagggccacaaacacatacacagagatacacacagaaacatatacacacagggacacacaccagagatacatacacagacacacacggacaggcagacacagggccacaaacacatacacagagatgcacatagaaacatttacacacagggactcacaccagagatacacacacacacggacaggcagacacatggtcacacacacacacacatacatacagtgatattcaacaagggaagggtgcacccacaggctcagtcttgagacctctctccaggctcctgggtgggttggggaagctgagcctccctgcctgctcatagcacacagcctccacaaatcttgctctattccagagtgagaaaggaacgttaaaactgatgatccctgatggccaaggctgccttatcaagatcctgttcccgattcaataagaaaagatgcctcttgtgccagcagcagataaggctgcagccctgggcgttcccaggagagcgaacaatggaagcccccaggatgcctctatatgaggtaggatggttacttgcccagtccctgcctgccaggcccttatctgggaggcgctggttcgggttgcaccctcctgtgttcctagcgggggctgctgcacaccaggcttctgaggccttcctggtgggggttggtggaatggcggcggggggagggttttgacggtgcatcctgaagtgctccctgcacctttcccagaaaaagaaaaggatgccatgaaaacacttcaccctagacatggtttaccctcgggaaagctgatgtgaaagaagttccagggggccagggatagaaaaggatttagaaagatgaaggcaacagacaaacgacacttacaaagtgcccaaagtctgcaagtcctgatagtcacagggaaggacatcagctggcgggaaacctcaccttttaggcctgcatgtcagtcttgcactgctgagctgtgtgaccctaggcaggctacttaaaccctctgtgccctggcatctccatctacagaataaagcttctaacagcataggcctcacacacctgtgtggagaccccataagtcgacaacatgtgtttacccgaggaaataaatatgggtgcccctttaggcctgtcccacagagttatacagctgaaagacctcagagtaggtccacaccccttaccaagtaatgcaggccttgattaattgccacttgaagggaggtggggagaaagcaccctgtcacatcacagctaaatttactaaaaaagaaactctttgcccacttatctttcgaaagtgcctcacagcagagacagccccaaccccttcctctctctccagcctcacctctcctcctaaaattcagttcctcctcacactctcagtgcctggccccggccatgcattagatgccctgaagagcttttgaaaaggaccaatccctgggccctatctcaggtgtgtctgagcatctgtagattttagaagctctgaggaggatttacatgcatttagggtggaaatcacttgtaagtaaatttttttaactgttccctgttaaaaaatatgaaccaatggaccaatggaccacttatggcttctgctaattctcttacatatgcccatggtaccttgttgcagtatcatttgtataataaaaagattggagccaaccagaaagtccatcaatggggggaaaattaaataaaatgtagttcattcagcaatggaatactatgcagctctgaaaaatgaatcaggaagctttctatgaacagatgtggaaagtctccaatgtatagcattaagtggaaaaagcaagacataatggtagtgtgcacgttctatattacaaaaaatgtgaataaaggcagtttatattcatgttttcttggatatacatttaaaaaactctaaaaagatacacaaagaatggtctagtagtcattatagggggtctgggaaggcaagagataatatatcatattttcaaatttttgaattatgagaacatgtcattcattcaaaaattgaatgtaaaaagggttaagaaagagaataaagcaagggccgggacacatctccactgtcttcccatggccctctcagaagtggatcacacctggtgctaggcagggggacagaaattgctgtggcctgagcagagcctgggtccagccagcatctacacagcccacgtcctcccaggggaatttctctgtgctctgttttgaggggatggtcctggtactggagtagcagagccaggtccctgcttcttgcataaccctgaggctgccctgtttgctcttcttgtgtggagggcattggcagaggcctctggcctgtagaacctttgtgagctgagccacaactcacttcgagctgttctctgccctggctttgctaccctgaggtctccagtgccatccacaccttccgtctgccactgccaacagccacaggtgatggatggggaccataatgtgagaggagaattgtgtactggaaatcagcatgaagggatatccaaagacctggagaaacccaaatcacatggggatgggagagtgaagacccaagggagggatgtgcggcaagacctgctctgagctctgagggtgcagatgtaatcaagactgagtgctgccccaccagacctgtagacgaactctccttctggtgaggcagtgaacctgcaagcacgggaaggtggtggtgggttgggtgccatggaggaaatgaggaagcaggagatacactgggggccaggtggggttgcaggtctcagcagggtggggctgaggtggtgatgggtgagggagtgagctgtggagtatccagacagggaaagcagcaagtgcaaaggtgctgggacaggagtggattttgcgggtctgcagggcagtcggtgtactgggagtggagtggatgaggtaggacatggaggctacagagtctcagaacccgtcagaggctggtgtgcagtcaggttctgcagggcattgttggccactaggaggattacaactttttctcttaccccaagtggacttgaaaccattggagggtctgagggaagagtgatatggtcagatgaagtttttaaatcatgtatttaattattctagttgatgtgtagagaatggaattggtgagggaggagagagtagaagtagggggacaagttaggactgatgggagattgagttgctccttggccgtcacaggattctgcatcctctgcctttaccatgggccttgcctgcctctcccagggacagagtgtacccctccaaccttattgactgcgcatttggccatgtgacttgctttgcctcgagggacatgagcaaaggccacatctgagcagaagttttgagggccattgcctggttggctcttgcttttttccctctgctctgagaagaggcatttccaacagggggtaccctccagtccaggtcctagaatgggaaagcctatggagcagggctgccaccgtggcacacagccatgacagaggtgggagtgagaatgagatggctgtcgtcgtaagccttggagatgtggagagtgctgaccgacacaggggcccttggggtaccagactacagaggcactgctggaacggtgtgaggtgagttgactttgtaatgttttctgaacagcagagctacccaaattggagtttgatgtatggcattagggagagtttgatttggtttagggatatgttaagttcgagatactcattagacatctaggtagaggctggagttcctggaaaatgtcaactacaggtacaacttggagtcatcgtctcacatttgcaaactcaatatatgcaaatggtatgaaaagtcatgaggctatacgtgatcaaccagagagagggtgtagaaagaggtgtcttcttaggacctggggcactccagcatgtgcagaatggagatctcaaagggcgagtgagcactgacctggtggtggcataggcaggtgcatgtcagggagagagaacctgtgtgcaaatacaaggaaggtgagtgacatggtttggctgtgtccccaccaaaatctcatcttgaattgtagctcccataattcccacatgttgtgggagagggcaggtgggacatacttgaatcatgggggcagttctcgtggtggtgaataagtctcgcgagatctactggttttataaggggaaactccttttgcttggctctcgttctgtctttgctggctgccaggtaagatgtgccttttgccttccatcataattgtgaagcctccccagccacttggaactgtgaatccattaaacctcttttccttttataaattacccagtcttgggtgtctttatcagcagcatgaaaacggactaatacagtgagagagcatgacaccttcaagaagggggcagaggacaaactctccagcctgcctgggctcatgcccagcactgtggcccttctctatccaggagccttccctgtcattatgcacaccctcagtcactgtcctctgcttggcagcacctctctggactcacggtttgtggaccagtttgttctcattaatcccacgacttaaatttctagcacccatgacacacaacctttccctctcctaactcaacccctttgtcactttcccccacttctgacgtaaaggtaacccatcttccccaattacaatttcttgtggcccagccttgccccagtaccaatttttaggagatgatttttgtcaccataggttttattttactgtgaaaggcataagatttgtttggggctcttctctctctatgtccaccttccctgccctcaagttcaccatgctcccccagcatgatctccagtcttccctaatggctgttggctccacttccctccagcactctaagagttatcagcctgcagaattatgagctgctcaggtcaccctacagcaagtcactcctcccacccagatcattctccctcaacccatcagagcaatccctggaaaacaggaaggtggcccttcactccctcccctgccacactcccgcctggtaattccaccatggctgctttcagcctcacagggacctcaagtccctggatacttccatccatgccatgatgtctggaactctcaagaaatattttggacagtttatctgcctgctcttggatttattgagcagggaagaaactctgtaagttcacatatctctactctatccctgacaattttttctgggactggagaggaaccagaaagggaatggagttggggattgaggaaagaggggagaaacaagagaagggaataccttgggcagctgggcaagaagaaacaaagccacaccatccagagacagggattttggaataactgcaaagtcacaaaagtattgggaagatgacttaatgcccttgaattcaagtcctcagacatacacagatattgtggtgatcatcatagcaaagctagccttcccaggaaagagaatgccagaggttttcctcagaggaggcatagaattagcctagccagtgaccagttagccagtgaccagttaaaggacaagtgttgactttgactttaccccagtccactcacgctgccacccccatgccctacagacccagccatgtccttgtgtaaagcacaccaggagacaccaaaggtatcacagagcaggtccaagtgggacatgggttctgaaaccttaatgcaaaccaatggcatgctggtatctgatcccaccatgaccttcatctcgagaaaggtgccacgaggctgtttcttgaaaggaagttttgttgacctggttcctatactgaatatgaccactcactacctggatttctttagccatttggaataggagcaagaccacaagcgctcattaccttcctgcatgaaattacatctcctgggaggaagagagccataaacatcaaggtgggtgtcacctggtcttaatttcttggcttcattagaaaaatctgagaacttggaatgacatacccacagagaacatttgggtttacataaactagtatatccttcatgtataaatacatagtttaatgtaaaagaattgtgggcccaaaccaacagttttagggtatttaattaggatattattcaataagcacaaacggctcttcctaggtcggtatttgattcaccactgaaaaatttgaaactaggaagcaaatctctagagaagttgcatttattattttggagtaatggtaaactttggggatttgatgaaaacgatgggccatctcatcataaaaattcacacatacaaacatttttttctatgcaatttagagggtacccagccctagctaagaatctctgatctattgattaaaattctaaaataactaaaataatatgcatttatttatttatttatttattttgagatggagtcttgctctgttgcacaggctggagtgcaatggcacgatcttggctcactgcagcctctgcatcttgggttcaagtgattctcatggctcagcctcccgtgtagctgggattacaagcacgtgccaacacgcccagctaatttttgtatttttagtagagacagggtttcaccatattggccaggctggtcttgaactcctggcctcaagtgatccacccacttcggcctcccaaagttctgggattacaggcatgagccaccatacccggccccaatatgcattttcttagtgcctgaaagctacgatgacatgggcatgaaatgggcccagtgcagactacatgtgtgagaagagacttccttcaggccagcacgacacttcttccctatggtcacaagtgcctttttcctctttgtgtaacaactcctctctaaccatctgcagtttgcatgtgttgaaccaaaccctaactccaaaaacttaggtctggtcagttgaaacctcccatttatttggctacagtgatgggtttggggatggatatgtgaccaaagtcagtgagtgagactcaattccaggactctcttgagactactgggaaaaacaatgctatttctgttggagtggttgagaggccatgatgtaagccagggattctcaaccagtggtgatttcacctcccatgggacatttgggaacacctggagacatttttggttgtcacttctagggatgtgctactgacatgtattgggtagaaaccagggatgcagttgaacctcctacaaatgcatgggacaaccatccccaacaaagaattattctgccacaaatgccaataatgcagaggttgagaaacgcttctgtaagcttagagtttgagcaactattttggtgttgcataaaatgagcctgcccaagactgaggccaactgaaaggagataaagctgagagatggaggaagggcaagtcatgaagatgtcctttgagatctgggatgcatctctgtctgaagttgagccctggactttacaaaactgtatcatttacaagtaattgcttcctgattcagccttctgttgattcaacaacacatgttcgttaggtggctgccaggtgccaggactcttactttcattgagttataccagcaacgatgttaatgagaaacaaataacacagataaataaagaaaatagaactgggaatggcggattgcatacagaggctaattcagatgaggaggaaactggaaatcaacaacagaacatcctccgtgtgcatatattgtggtctatgatgtatgaaaatgtaaagtacatgatatttggtgctcctgaaagagtgtggctgcagtcacagtcatcaaatccttgcagtgtcttcacaaaatctcaagttcagaacccctctaggattgctatgtaggtactagtatagaagagagcatttctgatctgtaaagagaaaacatgcaggattctgccttcagatggcattttatttcctggctgggggcatgagacagacttttggtattgaaggactttgactcctagatgctggcaaggctgtggagaaatagaaacgcttttacactgttgctgggaatgtaagttaattcaaccactgtggaaggcagtgtggcaatttctcaaggatctagagccagaaataccatttgaccaagcagtcccattactggatatatacccaaaagattataaatcattctgttataaagatgcatgcacacatatgtttattgccacactatttataatagtaaagacttggaaccaacgcaaatacccatcaataatagactggataaagaaaatgtggcacatatacaccatggaatactatgcagccataaaaaggaatgagttcatgtcctttgcagggacatgggtgaagatggaagccatcattctcagcaaactaacacaggaacagaaaaccaaacactgcatgttctcactcataagtgacaattgaacaatgagaacacatggacacatggaggggaacatcatacaccagggcctgtcgggaggtggggggcaatgggagggagagcattaggacaaatacctaatgcatgcaaggcttaaaacctagatgacgggttgataggtgcagcaaagcaccatggcacatgtatacctaggtaacaaacctgcacgttctgcacacgtatctcagaacttaaagtaaaatttaaaaaaattaaaaaataaaataaaataaaaataaaacgattttgacaccacgaaattgctgagtcctgaaagagaacaaatggttctgtgcagaccaggcactacagagaggtgcagagctgaggggcaaatgaaggctcacatggagcccaagctcccatcacccagtcttgcacttgccttgagtgtgtgtaaccccagggaggggcacattgttatgaattatttgcccagagggtttgtctgccctgagcaagtgcctttacttatttacacaaaggggtcctctgtgctgggtggtagccccactggtggaagctgtagtgtgccccaatctctcttctcatgccttctccatagtcacagagcaatgacagcattcttctggccccttgctgtcagatgcaggcactgcctaccatctgatcaatggggagtaatcacacatgccatgcagcagcttatagggacttccctaagggacatctgtcacatgctttttgtccctgttctttatcctttcctcattagtgctagctggactgcagatgttattcaaccaaagacacatgccctgatgaaacgcacacggggcctgctggggaagcacttgttggagaaaactccaggagtcaggagcagaagtgagcatgtggatcacctgttggacataatggttctgcagcagtgcacagagggcttacagggcctggcatctgactgtgggagagggacttaacccttaggagggttttaaacttatgtctcctagaaagactaggagtttggatccaacagcagtaagaggcagcgggacctgtctctggtttaattccatcagctcagattcatggctgaggaacactcattccatcccttggtgaaccagggtttgaagtccaaaccttgcagtctcagtttccatgacatggcagatgggacctgatttgccacctcgagcactcagctgtaccaactcagacaccaacttgtgggaaatcagtcttgaaaaagacttgtagcctgtgttggtcagttgttccaacacaagtctcagagttgctctgtgaaggtattctgtagatgtggttagcatcaacaatcagtttgctttgagtaaagaagattatcctttttagcctgggtgggtgggccatgttgaaagacattaagagccacactgagaaagaagaaatgctgcttgtagatgacaatgtcagctcccaccacagtttccagcctgctagcctaaggatttcaggctttcccagccagacccccaattccttgaaataaataaatatatatcttactggttctgtttttctggtagaactctgatacctagtgcaagtccaacttggacttgcttttccatgaatatgttggaattagagcatctatgtttgaccagcataactatgcacaggggagcaacaagataacaaagatcctggatcttcttaccctgcggatccacaatagcccttggccatacacctctggatttttacacagaaaagatgcaaacttctacctcaatgaagccattgtttttcttctctcatagcaaacttaatcctaagtaatgtatatttattgggtgactattatttgctcaacagataaggaaagagaacttctgaggaactaaatgacatacccaagatcacgcaaccagcaagtggtaggaataaatgcacgcctgtggggtttgaaagcccacactatttgaactacaaaatccagaatttcagggtcccacttatgcttctacaacagcccttttacatctaggcgtggggggaatatttccttaagcaatagtctttggcttcagaaaatctgagcgtcgtcatatactttcacaatggaatgagagaagagccagccaaaggtatttcagaagcagagagagcactttgcagatttaaggtctaccaaggctatctcagcttagccattcttcaggtctaacgcgatgtactaggttagacagaagtcacaggccgaagtccagagaaaacaagatgcatcagtcactgtgtaactatttattgctgtgtaacaaatttctccataaacatttattatctcacagttttggtggatcaggcattcagaagcagctcacgtgggtggctggtggctcagggtctctcatgaggtttcagttaagatgttgaccaagactgaggttacacgaaggcttgactggggctggagaattggcttttgacaggaggcttcatttcctcatcccatacacttctctgtagggctgcaagtcttcatgacatggcagtctcttcccccagaataagtgatgcaaagagaaggccacgctgccttctatgacccagtcccagaagtcacacactgtcacatctgctatattctattcattaaaagcagatcattgggtccaacctatacaaaaagggtggggaaattaagctccactcttgaaaagaggaaaatcataggcgacccatattagaacaagacagaattctgcacagactttcatcaacaataactaaccaacagagggcatttggcagaggaagcaaaccttctgtggaataacgaaacctacggtacagagagtgaactctcagccacctcccaggaggacatgaaacatcctctgcagagaacaattagagtgcagcacatttcacaacattgctgaacactgctccaacaggggcatgctcctggtggaagcaaaactggggctcagcttccatcctaggcctctggacccgtgatgggaagggttctttttccatattatttaaaaaataactaaagtcaaagggacattgtatatacagaacagtgtttgaaatgaacatgtataaccaataaagaaaacactaccacaaagagaattagaacattgccaggctcttaaaagatctgattctcccttcttaaccccatccctcttcttcccgttgagaggtaatcactatcttggctttggaataatcattcccttgcttttcctcgtttttttgtttgtttgttttgcttttttcactaccattgcatgacccctaaataatatattatctttctctgctttcaaaatgtaaataaatggaaccatatcatatatgttgtcctgctacatgcccctttggtgcgacagtgagtttgttagtttcattaattgctgtataaactccattatgtggatatacctgcattggctaatccaatctaatgttgatggattcttggttgatgaatgctcatgaaaaaatttcttttttctatatgcatgacccaatcacctcccaccaggccccaactccaacactggggattacaactgaacatgagatttgagcagggacatagatccaaactgtatcagacttttttttattaactttaattttgagttcaggggtacaagtgcaggtttattacatagataaacttgtgtcatgggtgtttgttgtccagactatttcatcactcaggtattaagcctagtacccataagttatttttccagatcttctccctcctcccaccctccccgctctgaaaggccccagtgtgtgttgttcccctctatgcgtccatgtattctcatcatttagctcccacttataagtgagaacatacggtatttggttttctgttcctgtgtgagtctgtgaaggataatgacctccagctccatccatgtccctgcaaaggacatgatctcattctttttatggttacatagaatttcttggtgtacatgtaccatattttctttatccagtctatcattgatgggcatttaggctgatttcatgcctttgctattgtgaatagtgctgcagagaacactgaggtgaacatgtctttataatagaatgttttatactcctttgtgtatatacccagtaatgggattgctaaatcgaatggtatttctgtctttaggtctttgaggaatcaccaccctgtcttccacaatggctgaactaattcacactcccaccaacagtgtataagcattcctttttattcacaaccttgccagcatctgttattttttgactttttaataatagccattctgactggtgttagatggtatcttattgtggttttgatttgcatttctctaatgatcagtcatgttgagctgttttttcaaataattgttggccacatgtatgttttcttctgaaaagtgtctgttcatgacctttgctcactttttacaagggttgtttcttttctttgtaaagaaattaataaatttaagttccttatagatgctggatattagacctttgttagatgtatagtttgcaaaatttttctcccattctgtagattgtctgtttactctgttgatagtttattttgctgtgcagaagcttgttaattagatcctatttgtcaatttttgcttttgttcagttgcttttggcatcttcatcatgaaacctttgcctgtgcctatgtcctgaatgatattgcctaggttgtcttccatgatttttatagttttgggttttacatttaagtctttaatccatcttgctttaatttttgtatatggtgtaaagagggggtctagtttcaatattctgcatatgacttaccacttatcctagcaccatttattgaacagggaatcctttccccattgcttgtttttgtcacttttgtccaagatcagatggttgtaagtgtgcagtcttatttctgggttctctattctgttccattggtctatgtgtctgttttttgtaccagtaccatgctgttttggttactgtagccctgtattatagtttaaagttgggtagtgtgatgccttcagctttgttctttttgcttaggactgtcttggctattcgggctttttcatatcagactttttaatgtttgacaatatggtgggtgcaaaatagatattattttgattttaatttatatacccttagttaccatgagcttgagcattgtttataattaattgttcatcatgtttccactcttgaaaagtgatctattcaattcttttgcatatttcccaccgtttttacttgttgatttacaatagttaaacattttggttactagtgttttgcaggtgatatgagttacaaaactttctcccagcaggtagtttatcttttcactctctttaatgatatattttaatttaaacacccttaatgttaatatagtaatatctatcaatatttcttttacaggttgtagtttttatgtcttgttttataaaaccgttttgcacctcaaggtcatattctcctgtaataccttctaaaatgctttataagtttaaattttacatttaaatccttaatcatatatgtgtgactgatttttacatgtggtattatgtaggggtccaattaattttccccattataaagatttctagttgtttggcctcatttattgaaaaatccactctttctgagttgatgtttagtactatttctgattatatcaagtatgcatatctgttagattagtttatggactttcctattccattgttgtgtctcttttgagccatccatactgttattcttaattacaataactttataataagatttagttcctaggggaacaaaaaacacaacacatgtgctgtgctttcaagcatagctgggcctgtgcaatctggccctctgtgtaattttaaaaacagcttgtaaaaaaaaaaatgtactgccggattttttttttcagaggaattgcagtgggtttctagattatcttgcaaacaatagacatctttataatatggaattattaaatccatgtacatgatccatcacttcatttgcttacgttgtctttaatgtttttaaatgaaggtttattgttttcccataaagctcttgcatatctttatagaattattcttaggtattacatttttatgctattgaaaatgatatatttttaaatttaaccttctcaatgtatatgttagtatgtaaaaatgcaattgaattttgattccaacaattttgctaaaactcttaaataaaattcaaaaattaacctaatgattaattagaattttatacatgcacagccatattttctatgaataataatagatttgtttcattccaatacttaccatttttatttcttttttccttaccatagtattctggtgagcctccaaacctatgttgaatagtaagcatctttttcttgttcttgacagcaaagaaaatgcttttaattatatagctttatgtgaaatatttgctatacattttctatagacactattatcaagttaaagaagtcatattcttttcttagtttgctagtagttaataagatatagatgcttaattttactttctatatgtattcagataatcatacttttttcctataatgttttcatgtgggggatacattaattgatttcccgatattaacccaactttgcactattttgatcaacccaccttgatcatgatataatttctttcttatacatggctgaattctccttatgaatatttggttaaaatttttgcatcttgcattcataagaataattggcctttttttgtactgttattgtttttggcatcaaagttatgttagcctacaaattttaaaaattttattggggagtattattcttttttatattctccaccatattttgggaaattttggaccttaaatatttgattgacctaactgatgaagccatctgactttagctttctttgtgggaaaagctatgactatgaattcagtttctttaatggctgtaagatcattcaggttttctgtttcttcttgtgtcagttttgctaggtttgttttctacacaaatttattcatttaatatacttttcaaacaaataggcataaagtagttcacaacatcttctaatcatttgaaagtctttagcaaccatagacttatccccatttttattcttaatattatctgtcttttcttttttaaagtactctcactaaagacaagatttgtccattttattaatcttttaaaaaactccaatttttatctttgttgattctctgtattttcagttgttcaatttgttaatttctgttatctttataatatcccacttcctaattgtttttatttgttttttgtttgttttgctgcctttttgccaactttttaaaatggatgcttagtttactaattatcatccttttttttctatttcaatataaatatttaggactataaatttctatttgctgttttagctgtataccacaaattttatatgtattttattatattaaatcatattgtctaaattacattgtaatttcttttttgaaacgttagtatatttcctaagtaaatttttctacttaacttttaattgacatctagcataattactttaggtctgagtaggtattatattattttagtcatttaaatgtgttgtgattttctttataaacctattcatggtaaatttgtaaaaatgattcatgtgtaagaatttgtattttttagttgttgggagcagtactctaaccccattaagtcaagtttgttaatcttccatttcttgttttttttttcacctgttttatcaatagctcacacaactatattaaaaagtaggtatgaatgtagtgcaagaaattattttcttcttgttataaaatcaaaatgaaattgactccaccaagaattggtgagaattttgaatattttaatgtcatcatcattgtgagttctgctctatccatagatcctggaagcaaaagtcttctggtcctcagtgcacactctttgctccaaaccctataggttgtggtttcagtgtcaagtaaaggtacagggatccctgatggggctagaatctgcataaccaaggcttcagctccctggcagagccacactctgaattcctgtaagtatccaggacttaaacattcataatggtctaggtccccattgcttgtgaatcctatagactctaatcttttcccattaatgggataacttctcccaacatctctctcgttttgctactcttcttattgtttccttttacattttgttttcaaaaatttccccaagaactttgagaagttcaatttaaactactctaccttgggcttgagggtggaggaatgagatgctgagacgtaagatctggtaataatgcctacaataggcatatttccctccacagaaaggtcagtacctctgtaaatatacaaaccaactgcctggcttcctgtttttttctgtatcacgttcttgtagtaccattgagaaagtagcactgggaggttgaaaatgtacctggctagcatccaagtcctgggtctgagttcaagctctgcttttcactagctacatgttttaagatgtatattaccatcttggagtctctacttctcatcttcaaatggggacaggaattctgcaagactctgaggtctacaaagtcagggcctgtgttctatttctttttgtattccttgggcctaattccacatctactattgtagatcaaatctttgttgtgaatgaaagaataaataaatttctgtcttcaagattttttgctatgatgaactgagacagcacatgagtaagctctttgtaaactatttttttttaagcacatgaaaaatgtatattgttattgtcacctttctattatatttcacagcaatgtgagatatcctcaaatatgcttttacatccctcatcctcaaatgtttagatcatcccccaatatttacatatttttcagcaattgtttaatataatctctacccaaggaagagatagaagccacttgaaaaaaagtcttagggacatctcccaaaactgcttattatttgaatggcttatattttaaaatgtgtgcagccaatttttcgctctcttgtgctccaacccttcttcataccacaggctgtgggcgtctgccccacagaccctgacccaatgacagatgaataatgtacactgacacacagatattctgctttgccagtccagctaagtgtctcagctgcttacagactccctggagagtactgtaaacagttgtcgaccagctagtgagacttacatttatttggtaaagattaattgacaaaggctcgagtcaacaccactacagggtaattgacaatgtggacttcccgagtagaaagcaattaagcacctgtggtaaatcaaaggttagtcttaagaccacatgagtaaacaagctagctagaaaaactctccacattcctttgttactactttaatatatttaactaaaggtaaagggaccaggccaccttcagccagatctattaccgaagttatgcaaactctcaggccttccaagagagtctgtggctgttactataaccatctttaatatttttcccaccagcctgattgaacccctacaacagactatggtaggtcagacccagaagtgccaagacttttcagacatggtccacaggtgtagcaagatgccccaagccccactcctcagtattttttggttcattaaatacaaaaaatgaacgttgtacttggccttatattgttttttaaaccacagactgcttgggttttgttttgttttgtttccatcactagtatgttttgctcctgaagattgttttctgaccccatgcctttgctcaagaaaagaaaaaattccctgcctggaatgcattctattcatcaaaacccttccctttctgaaatatcacctccttcaataagcctttcctgctcagcccactatatgagtatgagtatcctcatactcagaagcagctcacacatgctaagctgccctactccaattaagaagaaaatactaacacagcatctatagctttcattcaaggaaggctgagtacttgttaagatcattttttctaagttcacttagctgttaaagcagcaagggcaggatttggatcaggttctgtttggttccaaacccaccatgaggagccactgtgctgttttacctctgagaaagacctgacttaaaacccgacctctatgttatgagagtcaggctcctaggatggggaaccacgataggtgcatgcatgtcttgtcttgcattagagatttttatgtacattttccctttctagattataatctctccaagggcaagaactccctaacacctttctgtacctcttacatcattgtgacatcaaagattcttagcaaatgcttgttaagtaaatgagagcagacattcttgctccccactgattttatcttggatgctaataatacagtaaccttatttccaaaaaccattcccacagagcccgacacaccgtggaacaaaaactgagaattggattgaagaactggattgagaaaaggaaacactttggtgaaatcacaacctgtaaacagacctcaaaacatagtgttcactcaactgaagctgaacgttctatagcctgggttcatttggcttgattgcgcatcacttgtttacttggtgtgtataacactccacaggagtcacagggtccttttataggcatctctggtctgttgtgggccccgggtagtcatagtcccactgtcttgctcattatcctcctgcacccccaacacaactggacatcacacactaacttaacaattcagcctccttccaactgtcttaccccttctatctagtttcttcctgccttaattaacttcctagcatcatatgaataatcatttgtttgtttgctcatcctattgtggttgcccatcctatgatcttaacaagtactcagccttccttgaatgaaagctatagaccctctgttagtattttctttttaattggggtagggtggcttagtgaacatggacctgacagtgttggtttaaaatccagtgaccattgcatagttccactttaaaatgccctatgtcacattagtgtgaatgcacagaggcacagacaggcccagggtctcaggttagaaaatatgatgaggggaggggtttcttctaaagagaactgtggaattgtcggatgtgaatctgggcctgttgttcgtttctcgctatgcatgtttccatgggacggacactcagttgttactctcgctctctcccaccacttccgctctctttcacaggaagaggcgggtcctaccctgatggaaaccggttctggtctctgtccaatgggagtcgcttcctgtcctgcaccttcccaaccacatcagtgaaagggtggaagtgctggtctgcccactgcaggcttaacccatgttcttcctactaggaaagggacgtttccattttcatccacctgactcccgagttggttgcaaagatggaagaaaggaacagccatttattctcctggaggcaggccctgccggacttgagagggcctttcctctgaccctaagcatcagagcggatggagacagaaaatcctgaggccgctgtatggtgggtctcttcacagccatggggcccagccccactcgcctccaccaggttatggcccagcagctgggactccgtccagaagagcacctgcagcacgtatcctgtgttctccatcaaagcggcctggagtccgcctgcgtccccagcaagcagcactcccgccctaaaaccaaagggcgcagcaaggaaatgggagggctgcgctttgcttcctgtctgataactaccaacaaccgggcttctgcccagcatagctagataaggggagggcactccatttgacatgccctgaagactgtccaagcgatggcttaggaaggccattccaatttcaagtcctgaaagctgtaagatttttctgtgacttagagtgatttataacatagtttaacctctcaaagcttcacatctgtaaaatatggataaaactatctcaaagcggtattgtgcaagttaaatgaaaaagatagtgtatgcacattgtttggcactaagctattattattatcaaaagtagtagcaattagtattattgtttaaaggagaaaatgatatccattgggaggctcctctttggacctgaaagcttaatatctggaattacttagaactggaatgccagcctccgcctcctgccagcagcctgctgccaattctgatgagacagcttagaaaccattgccctgatgccatagaaaagaagaggacagctagccttttcctttctcttcacccttaatttaaaaaggttgggcaagttacacatccacccacctccaaacctttcaaacaagtttcagttatattcttgccgagtagaaaaaccaaaaattaataagagaacttacttaaaataaaaagttgttaacatcttgatacatcctggctttccagttaagagactttacagaatggttcgtgacttctacaccaaattctttcttgtatattttgtctacaccccaccccttccttagcctcaacctcatgagtgcaaatggagatcagccctggctcctggcatcccacgacgacttggaggtggaaattgttagtctggagtgggattgagggcccctgaggcagactgacactctttcagctgatgcatgtctaatgctgagcaggctgtgaccaaccaccctcaggacatgtttttatgcaagtgtgctgtagggggtggtcttcctcataagtgagaaaacatgaaagcaaagttcatttatcccatcagttggctgcttctcaccattcacctgggccctgcagtgctgagaaaataggatgtattttaatctccaagcagactggactccaatcaatttagagacacagagccacaacataattcaatttggggtgattccactgtctctgtaatgtctaaagccctaatgtactgctgactcttaggacaaactggcactgatcaagagtgaggccactaagccatcactgatttcagactctcacccctgactttctatgtatggacaacacttaatatttcacagaacccaagttgcactggaccgaagaagacctaaatagccatgtagtccatgtgctgccaaacacctggcaaatagttgcatggttgttaaataagcacacctcatatccaggaactcctggacaaaggctgaccattccatctggacctcctccaacttctaaaaagctttctcttgaatttggccaatgggcatccctgctgagcccacctttagtccagatgttacctttctggatgttcattcatgcatatagctgcaaacgttttccaacagcttgatattgctaggcactgtgctgggtcctgaatcaatgggtgataagggtaatcccactttcagcagagacactgacagcccctacttgacatggtcctgggttctctcattccccttgtctctccccactgaacctgcactaactgtcctatgtccctctttaagtgtaggcccagaattgatgttgcagtctaatgtataacaaataagtcctcgtttgtgacctgtttcagaaaatgcaacctaagattgggcagtcatgtcaccttcccgtttaattttctgtccatatgaggcaaaatagcttaagattaagaaaaagcttttggaattaactagccctggaacaagcatttgttgcacctcttacgctgcagagctgggcaaattgttcaatctgtcaagacatttttttaagtgtaccgtaggggcagttggaaggagtaatgaggcagtgtgtatacagcacctgacctagtcatggctcattaaaagctgctattctacatctcattgctgtcatctccaaaacgctgaagtcttttcacatgtgctgctgctccatcaaactcccagatgttttggggaggactggatggaggtcctaacaccttcaagatctaacccgtcacctcagcctgttctttggcatcctggatgtgtcacataacctattgtcatctcagccccatggcatttggagctgagatcaggatagcttctgtatcctcatctgagtaaagtatgaccaagtaagttcaagggccgcagcctggggtttaatcctgcgacctcccttctagacgagcatccattttttaattagtactgtttggctgtgcttattcaatgagtcatgagtcataaacttgtaacatctccagattgttttatgaagtcatatcaggatgaaattctgcctacctactatttctgtattatcttctttaggaaacatgccatgtggctacagaacatgaaaaaaccattttttttttccataaagtttctacatataacatgcttcctgcagaagtttgtaattcacatattctagcactaattataatcaggtaatattatgactttctccaacagaataatagtttaacatttttttgtgagaagataatgatgttttactcagtaaaatgagtttaaaattacaagttagaaaagtttatctagttgtttctatatagcattaatctgggctgctttgtcaaaaatttattttatttttgaatcagggtgtcactctgtcacccaggctagtggcgtgatcacagctcactgcagccttgaactcctgggactgcagttgtgcaccaccatgcccggctttttgtatttatttatttttttgtagagactgggtactctcatgttgcccaggctggtcccgggctcaagcgatccacccgcctctgtccttcaaagtgttgggattacaggtgtgagtcaacaagatttctttaaaccaaggttaaaagataaaaagaaggcacagaatttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaa
